US012760314B2

(12) United States Patent
Kudithipudi et al.

(10) Patent No.: US 12,760,314 B2
(45) Date of Patent: Oct. 13, 2026

(54) TOBACCO PLANTS COMPRISING REDUCED NICOTINE AND REDUCED TOBACCO SPECIFIC NITROSAMINES

(71) Applicant: Altria Client Services LLC, Richmond, VA (US)

(72) Inventors: Chengalrayan Kudithipudi, Midlothian, VA (US); Dongmei Xu, Glen Allen, VA (US); James A. Strickland, Virginia Beach, VA (US); Marcos Fernando de Godoy Lusso, Chesterfield, VA (US)

(73) Assignee: Altria Client Services LLC, Richmond, VA (US)

( * ) Notice: Subject to any disclaimer, the term of this patent is extended or adjusted under 35 U.S.C. 154(b) by 240 days.

(21) Appl. No.: 18/782,700

(22) Filed: Jul. 24, 2024

(65) Prior Publication Data

US 2024/0376488 A1 Nov. 14, 2024

Related U.S. Application Data

(63) Continuation of application No. 16/750,349, filed on Jan. 23, 2020, now Pat. No. 12,077,765.

(60) Provisional application No. 62/796,399, filed on Jan. 24, 2019.

(51) Int. Cl.
*C12N 15/82* (2006.01)

(52) U.S. Cl.
CPC ................................ *C12N 15/8243* (2013.01)

(58) Field of Classification Search
None
See application file for complete search history.

(56) References Cited

U.S. PATENT DOCUMENTS

| | | | |
|---|---|---|---|
| 4,516,590 | A | 5/1985 | Teng |
| 4,528,993 | A | 7/1985 | Sensabaugh et al. |
| 4,660,577 | A | 4/1987 | Sensabaugh et al. |
| 4,732,856 | A | 3/1988 | Federoff |
| 4,762,785 | A | 8/1988 | Comai |
| 4,848,373 | A | 7/1989 | Lenkey |
| 4,945,050 | A | 7/1990 | Sanford et al. |
| 4,987,907 | A | 1/1991 | Townend |
| 5,004,863 | A | 4/1991 | Umbeck |
| 5,013,658 | A | 5/1991 | Dooner et al. |
| 5,104,310 | A | 4/1992 | Saltin |
| 5,141,131 | A | 8/1992 | Miller, Jr. et al. |
| 5,149,645 | A | 9/1992 | Hoekema et al. |
| 5,159,135 | A | 10/1992 | Umbeck |
| 5,177,010 | A | 1/1993 | Goldman et al. |
| 5,231,019 | A | 7/1993 | Paszkowski et al. |
| 5,316,931 | A | 5/1994 | Donson et al. |
| 5,372,149 | A | 12/1994 | Roth et al. |
| 5,463,174 | A | 10/1995 | Moloney et al. |
| 5,464,763 | A | 11/1995 | Schilperoort et al. |
| 5,469,976 | A | 11/1995 | Burchell |
| 5,491,081 | A | 2/1996 | Webb |
| 5,563,055 | A | 10/1996 | Townsend et al. |
| 5,565,350 | A | 10/1996 | Kmiec |
| 5,589,367 | A | 12/1996 | Donson et al. |
| 5,659,026 | A | 8/1997 | Baszczynski et al. |
| 5,689,035 | A | 11/1997 | Webb |
| 5,731,181 | A | 3/1998 | Kmiec |
| 5,756,325 | A | 5/1998 | Kmiec |
| 5,760,012 | A | 6/1998 | Kmiec et al. |
| 5,789,156 | A | 8/1998 | Bujard et al. |
| 5,795,972 | A | 8/1998 | Kmiec |
| 5,814,618 | A | 9/1998 | Bujard et al. |
| 5,866,785 | A | 2/1999 | Donson et al. |
| 5,871,984 | A | 2/1999 | Kmiec |
| 5,879,918 | A | 3/1999 | Tomes et al. |
| 5,886,244 | A | 3/1999 | Tomes et al. |
| 5,889,190 | A | 3/1999 | Donson et al. |
| 5,889,191 | A | 3/1999 | Turpen |
| 5,932,782 | A | 8/1999 | Bidney |
| 5,981,840 | A | 11/1999 | Zhao et al. |
| 6,072,050 | A | 6/2000 | Bowen et al. |
| 8,124,851 | B2 | 2/2012 | Dewey et al. |
| 8,319,011 | B2 | 11/2012 | Xu et al. |

(Continued)

FOREIGN PATENT DOCUMENTS

| | | | |
|---|---|---|---|
| WO | WO 98/49350 | A1 | 11/1998 |
| WO | WO 99/107865 | A1 | 2/1999 |

(Continued)

OTHER PUBLICATIONS

Agrawal et al., "RNA interference: biology, mechanism, and applications," *Microbiology and Molecular Biology Reviews*, 67(4), pp. 657-685 (Dec. 2003), DOI: 10.1128/MMBR.67.4.657-685.2003.

Beetham et al., "A tool for functional plant genomics: Chimeric RNA/DNA oligonucleotides cause in vivo gene-specific mutations," *Proceedings of the National. Academy of Sciences*, 96(15), pp. 8774-8778 (Jul. 1999), DOI: https://doi.org/10.1073/pnas.96.15.8774.

Benzie et al., ""The Ferric Reducing Ability of Plasma (FRAP) as a Measure of "Antioxidant Power": The FRAP Assay"" *Analytical biochemistry* 239(1) (0292), pp. 70-76 (Jul. 1996), DOI: https://doi.org/10.1006/abio.1996.0292.

(Continued)

*Primary Examiner* — Amjad Abraham
*Assistant Examiner* — Christina L Meadows
(74) *Attorney, Agent, or Firm* — Arnold & Porter Kaye Scholer LLP

(57) ABSTRACT

The present disclosure provides approaches for reducing nicotine. Also provided are tobacco plants with decreased tobacco-specific nitrosamines (TSNAs). The present disclosure further provides modified tobacco plants with low nicotine and increased antioxidant capacity. Further provided are tobacco plants or material with low nicotine and low TSNAs. Also provided is cured tobacco material of the tobacco plants provided herein and tobacco products comprising this cured tobacco material.

21 Claims, 16 Drawing Sheets

Specification includes a Sequence Listing.

(56) References Cited

U.S. PATENT DOCUMENTS

| | | | | |
|---|---|---|---|---|
| 9,187,759 | B2 | 11/2015 | Dewey et al. | |
| 9,228,194 | B2 | 1/2016 | Dewey et al. | |
| 9,228,195 | B2 | 1/2016 | Dewey et al. | |
| 9,247,706 | B2 | 2/2016 | Dewey et al. | |
| 10,266,836 | B2 | 4/2019 | Xu | |
| 10,294,520 | B2 | 5/2019 | Xu et al. | |
| 10,375,910 | B2 | 8/2019 | Kudithipudi et al. | |
| 10,405,571 | B2 | 9/2019 | Adams et al. | |
| 10,647,989 | B2 * | 5/2020 | Kudithipudi et al. | C12N 15/82 |
| 11,000,059 | B2 | 5/2021 | Xu et al. | |
| 11,950,563 | B2 * | 4/2024 | Sreepriya et al. | C12N 15/82 |
| 2004/0118422 | A1 | 6/2004 | Lundin et al. | |
| 2005/0178398 | A1 | 8/2005 | Breslin et al. | |
| 2006/0191548 | A1 | 8/2006 | Strickland et al. | |
| 2007/0240728 | A1 | 10/2007 | Hashimoto et al. | |
| 2008/0120737 | A1 | 5/2008 | Hashimoto et al. | |
| 2016/0010103 | A1 | 1/2016 | Kudithipudi et al. | |
| 2016/0230181 | A1 | 8/2016 | Xu | |
| 2016/0374387 | A1 | 12/2016 | Adams et al. | |
| 2017/0233756 | A1 | 8/2017 | Begemann et al. | |
| 2018/0119163 | A1 | 5/2018 | Kudithipudi et al. | |
| 2019/0216037 | A1 | 7/2019 | Pramod et al. | |
| 2019/0246596 | A1 | 8/2019 | Pramod et al. | |
| 2020/0060136 | A1 | 2/2020 | Kudithipudi et al. | |
| 2020/0239899 | A1 | 7/2020 | Kudithipudi et al. | |
| 2022/0010324 | A1 | 1/2022 | Pramod et al. | |

FOREIGN PATENT DOCUMENTS

| | | | |
|---|---|---|---|
| WO | WO 99/125921 | A1 | 5/1999 |
| WO | WO 2004/041006 | A1 | 5/2004 |
| WO | WO 2011/027315 | A1 | 3/2011 |
| WO | WO 2018/067985 | A1 | 4/2018 |
| WO | WO 2018/237107 | A1 | 12/2018 |
| WO | WO 2019/140297 | A1 | 7/2019 |
| WO | WO 2019/140312 | A1 | 7/2019 |

OTHER PUBLICATIONS

Bowman et al., "Revised North Carolina grade index for flue-cured tobacco," *Tobacco Science*, 32:39-40 (1988).

Centers for Disease Control and Prevention's Protocol for Analysis of Nicotine, Total Moisture and pH in Smokeless Tobacco Products, as published in the Federal Register vol. 64, No. 55, pp. 13897-13912 (Mar. 1999)(and as amended in vol. 74, No. 4, Jan. 2009).

Cermak et al., "Efficient Design and Assembly of Custom TALEN and Other TAL Effector-Based Constructs for DNA Targeting," *Nucleic Acids Research* 39(12), e82, pp. 1-11 (Apr. 2011) DOI: doi:10.1093/nar/gkr218.

Chakrabarti et al., "CYP82E4-mediated nicotine to nornicotine conversion in tobacco is regulated by a senescence-specific signaling pathway," *Plant Mol Biol*, 66, pp. 415-427 (Jan. 2008), DOI: https://doi.org/10.1007/s11103-007-9280-6.

Chaplin et al., "Agronomic, Chemical, and Smoke Characteristics of Flue-Cured Tobacco Lines with Different Levels of Total Alkaloids." *Crop Science*, Agronomy Journal, 75, pp. 133-136 (Nov.-Dec. 1983) (Madison, WI).

Chaplin et al., "Association Between Percent Total Alkaloids and Other Traits in Flue-cured Tobacco1," *Crop Science*, 16(3), pp. 416-418 (May 1976), DOI: https://doi.org/10.2135/cropsci1976.0011183X001600030026x.

Chapple, "Molecular-genetic analysis of plant cytochrome P450-dependent monooxygenases," *Annual Review of Plant Physiology and Plant Molecular Biology*, 49, pp. 311-343 (Jun. 1998), DOI: https://doi.org/10.1146/annurev.arplant.49.1.311.

Chapters 4B and 4C of Tobacco, Production, Chemistry and Technology, Davis & Nielsen, eds., Blackwell Publishing, pp. 70-103, (1999) (Oxford, UK).

Chinese Search Report issued in corresponding Chinese Application No. 2020800231866, dated Jun. 28, 2022, with English translation (4 pages).

Christensen et al., "Maize polyubiquitin genes: structure, thermal perturbation of expression and transcript splicing, and promoter activity following transfer to protoplasts by electroporation," *Plant Mol Biol*, 18, pp. 675-689 (Feb. 1992), DOI: https://doi.org/10.1007/BF00020010.

Christensen et al., "Sequence Analysis and Transcriptional Regulation by Heat Shock of Polyubiquitin Transcripts from Maize," *Plant Mol Biol.*, 12(6), pp. 619-632 (Jun. 1989), DOI: 10.1007/BF00044153.

Christou et al., "Stable Transformation of Soybean Callus by DNA-Coated Gold Particles," *Plant Physiol.*, 87, pp. 671-674 (Mar. 1988).

Collins et al., "Determination of Nicotine Alkaloids in Tobacco Using the Autoanalyzer," *Tobacco Science*, vol. 13, pp. 79-81 (1969) (New York, USA).

"CORESTA Recommended Method No. 7: Determination of Nicotine in the Mainstream Smoke of Cigarettes by Gas Chromatographic Analysis," pp. 1-5, (1987) (updated Aug. 1991) (Paris, France).

"CORESTA Recommended Method No. 62: Determination of Nicotine in Tobacco and Tobacco Products by Gas Chromatographic Analysis," Coresta Cooperation Centre for Scientific Research Relative to Tobacco (Feb. 2005) (Version 2: Apr. 2020) (Paris, France).

Crossway et al., "Micromanipulation Techniques in Plant Biotechnology," *BioTechniques*, 4(4), pp. 320-334 (1986).

Davis et al., "Tobacco, Production, Chemistry and Technology," pp. 70-103 (1999).

Davis et al., "A Combined Automated Procedure for the Determination of Reducing Sugars and Nicotine Alkaloids in Tobacco Products Using a New Reducing Sugar Method," Tobacco Science, 20:139-144 (1976).

D'Halluin et al., "Transgenic Maize Plants by Tissue Electroporation," The Plant Cell, 4, pp. 1495-1505 (Dec. 1992).

De Wet et al., "Exogenous gene transfer in maize (*Zea mays*) using DNA-treated pollen," *The Experimental Manipulation of Ovule Tissues*, pp. 197-209 (1985).

Doyle et al., "TAL Effector-Nucleotide Targeter (TALE-NT) 2.0: tools for TAL Effector Design and Target Prediction," Nucleic Acids Research, 40, pp: W117-W122 (Jun. 2012), DOI: doi:10.1093/nar/gks608.

"Draft for Diplomatic Conference for the Revision of the International Convention for the Protection of New Varieties of Plants," (of Dec. 2, 1961, as revised at Geneva on Nov. 10, 1972; on Oct. 23, 1978; and on Mar. 19, 1991),54 pages, Mar. 4-19, 1991 (Geneva, Switzerland).

Estruch et al., "Transgenic plants: An emerging approach to pest control," *Nature Biotechnology*, 15, pp. 137-141 (Feb. 1997), DOI: https://doi.org/10.1038/nbt0297-137.

Fedoroff et al., "Cloning of the bronze Locus in Maize by a Simple and Generalizable Procedure Using the Transposable Controlling Element Activator (AC)," *Proc. Natl. Acad. Sci.*, 81, pp. 3825-3829 (Jun. 1984) DOI: https://doi.org/10.1073/pnas.81.12.3825.

Finer et al., "Transformation of Soybean via Particle Bombardment of Embryogenic Suspension Culture Tissue," *In Vitro Cell Dev. Biol.-Plant*, 27, pp. 175-182 (Oct. 1991), DOI: https://doi.org/10.1007/BF02632213.

Gaj et al., "ZFN, TALEN and CRISPR/Cas-based methods for genome engineering," *Trends Biotechnol.*, 31(7), pp. 397-405 (Jul. 2013) DOI: https://doi.org/10.1016/j.tibtech.2013.04.004.

Gatz et al., "Regulation of a modified CaMV 35S promoter by the Tn10-encoded Tet repressor in transgenic tobacco," *Mol. Gen. Genet.*, 227, pp. 229-237 (Jun. 1991) DOI: https://doi.org/10.1007/BF00259675.

Gavilano et al., "Genetic Engineering of *Nicotiana tabacum* for Reduced Nornicotine Content," *J. Agric. Food Chem*, 54, pp. 9071-9078 (Nov. 2006), DOI: https://doi.org/10.1021/jf0610458.

Goldman et al., "Female sterile tobacco plants are produced by stigma-specific cell ablation," *EMBO Journal*, 13, pp. 2976-2984, (Jul. 1994) DOI: https://doi.org/10.1002/j.1460-2075.1994.tb06596.x.

(56) References Cited

OTHER PUBLICATIONS

Guo et al., "Protein tolerance to random amino acid change," *PNAS*, 101(25), pp. 9205-9210, (Jun. 2004), DOI: https://doi.org/10.1073/pnas.0403255101.
Hibi et al., "Putrescine N-Methyltransferase in Cultured Roots of Hyoscyamus albus: n-Butylamine as a Potent Inhibitor of the Transferase both in Vitro and in Vivo," *Plant Physiology* 100(2), pp. 826-835 (Oct. 1992), DOI: https://doi.org/10.1104/pp.100.2.826.
Hildering et al., "Chimeric Structure of the Tomato Plant After Seed Treatment With EMS and X-Rays," the Use of Induced Mutations in Plant Breeding (Supplement to Radiation Botany), vol. 5, Pergamon Press Ltd., pp. 317-320, with cover page (1965) (London, UK).
Hoekema et al., "A binary plant vector strategy based on separation of vir- and T-region of the *Agrobacterium tumefaciens* Ti-plasmid," *Nature* 303, pp. 179-180 (May 1983) DOI: https://doi.org/10.1038/303179a0.
Horsch et al., "A simple and general method for transferring genes into plants," Science, 227(4691), pp. 1229-1231 with cover page (Mar. 1985).
International Search Report dated Apr. 14, 2020, in International Patent Application No. PCT/US2020/014724 (16 pages).
Kaeppler et al., "Silicon Carbide Fiber-Mediated DNA Delivery into Plant Cells," *Plant Cell Reports*, 9, pp. 415-418 (Dec. 1990) DOI: https://doi.org/10.1007/BF00232262.
Kaeppler et al., "Silicon carbide fiber-mediated stable transformation of plant cells," *Theoret. Appl. Genetics* 84, pp. 560-566 (Aug. 1992), DOI: https://doi.org/10.1007/BF00224152.
Kajikawa et al., "Genomic Insights into the Evolution of the Nicotine Biosynthesis Pathway in Tobacco 1[*CC-BY*]," *Plant Physiology*, 174(2), pp. 999-1011 (Jun. 2017) DOI: https://doi.org/10.1104/pp.17.00070.
Last et al., "pEmu: an improved promoter for gene expression in cereal cells," *Theoretical and Applied Genetics*, 81, pp. 581-588 (May 1991), DOI: https://doi.org/10.1007/BF00226722.
Legg et al., "Registration of LA Burley 21 Tobacco Germplasm1 Registration No. (GP 8)," Crop Science, 10(2), p. 212 (Mar.-Apr. 1970), DOI: https://doi.org/10.2135/cropsci1970.0011183X001000020041x.
Legg et al., "Inheritance of Per Cent Total Alkaloids in *Nicotiana tabacum* L. II. Genetic Effects of Two Loci in Burley 21 × La Burley 21 Populations," *Canadian Journal of Genetics and Cytology*, 13(2), pp. 287-291 (Jun. 1971) DOI: https://doi.org/10.1139/g71-047.
Lewis et al., "Three nicotine demethylase genes mediate nornicotine biosynthesis in *Nicotiana tabacum* L.: Functional characterization of the CYP82E10 gene," *Phytochemistry*, 71(17-18), pp. 1988-1998 (Dec. 2010), DOI: https://doi.org/10.1016/j.phytochem.2010.09.011.
Mayo et al., "Genetic transformation of tobacco NT1 cells with *Agrobacterium tumefaciens*," *Nat Protoc* 1, pp. 1105-1111 (Aug. 2006), DOI: https://doi.org/10.1038/nprot.2006.176.
McCabe et al., "Stable Transformation of Soybean (*Glycine max*) by Particle Acceleration," *Nature Biotechnology*, 6, pp. 923-926 (Aug. 1988) DOI: https://doi.org/10.1038/nbt0888-923.
McCallum et al., "Targeted Screening for Induced Mutations," *Nat. Biotechnol.*, 18, pp. 455-457 (Apr. 2000), DOI: https://doi.org/10.1038/74542.
McNellis et al., "Glucocorticoid-inducible expression of a bacterial avirulence gene in transgenic *Arabidopsis* induces hypersensitive cell death," *The Plant Journal*, 14(2), pp. 247-257 (Apr. 1998) DOI: https://doi.org/10.1046/j.1365-313X.1998.00106.x.
Miller et al., "A grade index for type 22 and 23 fire-cured tobacco," Tobacco International, 192, pp. 55-57 with cover page, (Dec. 1990) (New York, USA).
Miller "Memorandum: Proposed Burley Tobacco Grade Index," Legacy Tobacco Document Library, The University of Tennessee Agricultural Experiment Station (Bates Document #523267826-523267833) (Jul. 1988) (Knoxville, USA).
Morita et al., "Vacuolar transport of nicotine is mediated by a multidrug and toxic compound extrusion (MATE) transporter in *Nicotiana tabacum*," *Proceedings of the National Academy of Sciences*, 106(7), 2447-2452, (Feb. 2009), DOI: https://doi.org/10.1073/pnas.0812512106.
Odell et al., "Identification of DNA sequences required for activity of the cauliflower mosaic virus 35S promoter," *Nature* 313, pp. 810-812 (Feb. 1985), DOI: https://doi.org/10.1038/313810a0.
Official Standard Grades for Burley Tobacco (U.S. Type 31 and Foreign Type 93), effective Nov. 5, 1990 (55 F.R. 40645).
Official Standard Grades for Flue-Cured Tobacco (U.S. Types 11, 12, 13, 14 and Foreign Type 92), effective Mar. 27, 1989 (54 F.R. 7925).
Official Standard Grades for Pennsylvania Seedleaf Tobacco (U.S. Type 41), effective Jan. 8, 1965 (29 F.R. 16854).
Official Standard Grades for Ohio Cigar-Leaf Tobacco (U.S. Types 42, 43, and 44), effective Dec. 8, 1963 (28 F.R. 11719 and 28 F.R. 11926).
Official Standard Grades for Wisconsin Cigar-Binder Tobacco (U.S. Types 54 and 55), effective Nov. 20, 1969 (34 F.R. 17061).
Official Standard Grades for Georgia and Florida Shade-Grown Cigar-Wrapper Tobacco (U.S. Type 62), Effective Apr. 1971. A USDA grade index value can be determined according to an industry accepted grade index.
Paszkowski et al., "Direct gene transfer to plants," *The EMBO Journal*, 3(12), pp. 2717-2722 (Dec. 1984), DOI: https://doi.org/10.1002/j.1460-2075.1984.tb02201.x.
Porta et al., "Use of viral replicons for the expression of genes in plants," *Molecular Biotechnology*, 5, pp. 209-221 (Jun. 1996) DOI: https://doi.org/10.1007/BF02900359.
Qin et al., "NICI Cloning and Gene Editing Generates Low-Nicotine Tobacco Plants," *Plant Biotechnology Journal*, 19, pp. 2150-2152 (Aug. 2021) DOI: 10.1111/pbi.13694.
Riggs et al., "Stable transformation of tobacco by electroporation: evidence for plasmid concatenation," Proc. Natl. Acad. Sci., 83(15), pp. 5602-5606 (Aug. 1986), DOI: https://doi.org/10.1073/pnas.83.15.5602.
Rushton et al., "TOBFAC: the database of tobacco transcription factors," *BMC Bioinformatics*, 9(53), pp. 1-7 (Jan. 2008), DOI: https://doi.org/10.1186/1471-2105-9-53.
Schena et al., "A Steroid-inducible gene expression system for plant cells," *Proc. Natl. Acad. Sci.*, 88(23), pp. 10421-10425 (Dec. 1991), DOI: https://doi.org/10.1073/pnas.88.23.10421.
Shillito et al., "[19] Direct gene transfer to protoplasts of dicotyledonous and monocotyledonous plants by a number of methods, including electroporation," *Methods Enzymol.*, 153, pp. 313-336 (1987), DOI: https://doi.org/10.1016/0076-6879(87)53062-2.
Shoji et al., "Clustered transcription factor genes regulate nicotine biosynthesis in tobacco," *The Plant Cell*, 20(10), pp. 3390-3409 (Oct. 2010), available online: DOI: 10.1105/tpc.110.078543.
Singh et al., "Cytological Characterization of Transgenic Soybean," *Theor. Appl. Genet.* 96, pp. 319-324 (Feb. 1998), DOI: https://doi.org/10.1007/s001220050743.
Tomes et al., "16 Direct DNA Transfer into Intact Plant Cells via Microprojectile Bombardment," In: Gamborg, O.L., Phillips, G.C. (eds) *Plant Cell, Tissue and Organ Culture*. Springer Lab Manual. Springer, Berlin, Heidelberg, 2 pages (1995), DOI: https://doi.org/10.1007/978-3-642-79048-5_16.
Tso "Seed to Smoke," Chapter 1 in Davis and Nielsen (ed.), *Tobacco: Production, Chemistry and Technology*, Blackwell Science Publishing, pp. 1-31 with cover page (1999) (Oxford, UK).
Velten et al., "Isolation of a dual plant promoter fragment from the Ti Plasmid of *Agrobacterium tumefaciens*," *The EMBO Journal*, 3(12), pp. 2723-2730 (1984), DOI: https://doi.org/10.1002/j.1460-2075.1984.tb02202.x.
Verkerk, "Chimerism of the tomato plant after seed irradiation with fast neutrons," *Neth. J. Agric. Sci.*, 19(4), pp. 197-203 (Nov. 1971), DOI: https://doi.org/10.18174/njas.v19i4.17300.
Wiernik et al., "Effect of Air-Curing on the Chemical Composition of Tobacco" *Recent Adv. Tab. Sci, vol. 21* (*Impact of Plant Manipulation and Post Harvest Phenomena on Leaf Composition*), pp. 39-80 Symposium Proceedings 49th Meeting Tobacco Chemists' Research Conference, Sep. 24-27, 1995, Lexington, Kentucky, USA, available online: https://www.industrydocuments.ucsf.edu/docs/#id=xkvw0008.

(56) References Cited

OTHER PUBLICATIONS

Weising et al., "Foreign Genes in Plants: Transfer, Structure, Expressions and Applications," *Annual Review of Genetics*, 22, pp. 421-477 (Dec. 1988), accessed on Feb. 23, 2016, available online: 10.1146/annurev.ge.22.120188.002225.

Wernsman et al., "Chapter Seventeen: Tobacco" in *Principles of Cultivar Development, Crop Species*, vol. 2 , W. H. Fehr (ed.), MacMillan Publishing Go., Inc., pp. 669-698 with cover page, (1987) (New York, NY).

* cited by examiner

TOBACCO PLANTS COMPRISING REDUCED NICOTINE AND REDUCED TOBACCO SPECIFIC NITROSAMINES

CROSS-REFERENCE TO RELATED APPLICATIONS

This application is a continuation of U.S. patent application Ser. No. 16/750,349, filed Jan. 23, 2020, which claims priority to U.S. Provisional Application No. 62/796,399, filed Jan. 24, 2019, which is incorporated by reference herein in its entirety.

INCORPORATION OF SEQUENCE LISTING

A sequence listing contained in the file named "P34595US02_SQL.xml" which is 1,896,879 bytes (measured in MS-Windows®) and created on Jul. 22, 2024, is filed electronically herewith and incorporated by reference in its entirety.

FIELD

The present disclosure provides modified tobacco plants with low nicotine. The present disclosure further provides modified tobacco plants with low nicotine and increased antioxidant capacity. Also provided are tobacco plant comprising reduced amounts of tobacco specific nitrosamines (TSNAs). Also provided are tobacco plants with altered total alkaloid and nicotine levels and commercially acceptable leaf grade, their development via breeding or transgenic approaches, and production of tobacco products from these tobacco plants.

BACKGROUND

Four major alkaloids are found in tobacco: nicotine, nornicotine, anabasine, and anatabine. Nicotine is the predominant alkaloid, usually accounting for more than 90% of the total alkaloids in commercial tobacco cultivars. Nicotine biosynthesis occurs predominantly in tobacco roots. Tobacco plants then transport nicotine through the vascular bundle to leaves where nicotine is then stored in the vacuoles.

A variety of factors affect tobacco alkaloid levels including genotype, environment, fertilization, and agronomic practices (for example, nicotine production is stimulated by topping, wounding, and herbivore damage). Low-alkaloid traits initially found in strains of Cuban cigar tobacco varieties were introduced into cigarette varieties through a series of backcrosses. Low-alkaloid tobacco germplasm was subsequently registered in the genetic background of cultivar Burley 21 (Legg et al., *Crop Science,* 10:212 (1970)). Genetic studies using the low alkaloid Burley 21 (LA BU21) lines indicated that two unlinked loci contribute to nicotine levels in the tobacco leaf. These two loci are referred to as Nic1 and Nic2 (also known as NIC1 and NIC2 (or Nicotine 1 and Nicotine 2, respectively). The nic1 and nic2 mutations in LA BU21 are semi-dominant. They show dose-dependent effects on nicotine levels, with the effects of nic1 about 2.4 times stronger than those of nic2. Molecular characterization of Nic2 locus has been reported. The nic2 mutation was shown to contain a deletion of a cluster of transcription factor genes from the ethylene responsive factor (ERF) family.

Reducing total alkaloid content in tobacco can have many benefits. It can increase the value of tobacco as a biomass resource. Increases in nicotinic alkaloid in tobacco plants may play an important role in protecting plants against insects and herbivores.

Cytochrome p450s catalyze enzymatic reactions for a diverse range of chemically dissimilar substrates that include the oxidative, peroxidative, and reductive metabolism of endogenous and xenobiotic substrates. In plants, p450s participate in biochemical pathways that include the synthesis of plant products such as phenylpropanoids, alkaloids, terpenoids, lipids, cyanogenic glycosides, and glucosinolates (Chappel, Annu. Rev. Plant Physiol. Plant Mol. Biol. 198, 49:311-343). Cytochrome p450s, also known as p450 heme-thiolate proteins, usually act as terminal oxidases in multi-component electron transfer chains, called p450-containing monooxygenase systems. Specific reactions catalyzed include demethylation, hydroxylation, deamination, and reduction of azo, nitro, and N-oxide groups. Three Cytochrome p450s are identified as nicotine demethylase enzymes (See U.S. Pat. Nos. 8,319,011; 8,124,851; 9,187,759; 9,228,194; 9,228,195; 9,247,706 for exemplary nicotine demethylase sequences).

Tobacco-specific nitrosamines (TSNAs), such as N-nitrosonornicotine (NNN) and 4-(methylnitrosamino)-1-(3-pyridyl)-1-butanone (NNK), can be found in smokeless tobacco; mainstream smoke; and side stream smoke of cigarettes. It has been reported that air-cured and flue-cured tobacco contain tobacco-specific nitrosamines. See, "Effect of Air-Curing on the Chemical Composition of Tobacco", Wiernik et al., *Recent Adv. Tob. Sci*, (1995), 21, pp. 39-80. According to Wiernik et al., TSNAs are not present in significant quantities in growing tobacco plants or fresh cut tobacco (green tobacco), but are formed during the curing process. Bacterial populations which reside on the tobacco leaf are stated to largely cause the formation of nitrites from nitrate during curing and possibly affect the direct catalysis of the nitrosation of secondary amines at physiological pH values. The affected secondary amines include tobacco alkaloids, which form TSNAs when nitrosated.

There is a need to develop tobacco plants and products that contain altered nicotine levels (e.g., reduced nicotine) as well as reduced TSNAs while maintaining (if not making superior) tobacco leaf quality.

SUMMARY

In an aspect, the present disclosure provides a tobacco plant, or part thereof, comprising a first genetic modification suppressing one or more genes from a NIC1b locus, a NIC2 locus, or both, and further comprising a second genetic modification increasing nicotine to nornicotine conversion.

In another aspect, the present disclosure provides a tobacco plant, or part thereof, comprising a first genetic modification suppressing one or more genes from a NIC1b locus, a NIC2 locus, or both, comprising a second genetic modification increasing nicotine to nornicotine conversion, and further comprises a third genetic modification increasing the level of one or more antioxidants compared to a control plant lacking the third genetic modification.

In an aspect, the present disclosure provides a tobacco plant, or part thereof, comprising a first genetic modification increasing the nicotine to nornicotine conversion and further comprising a second genetic modification increasing the level of one or more antioxidants.

In an aspect, the present disclosure provides a tobacco plant, or part thereof, comprising a first genetic modification providing mutagenic or transgenic suppression of one or more, two or more, three or more, four or more, five or more, six or more genes comprising a nucleotide sequence having at least 90% identity to SEQ ID Nos: 10 to 19 and 30 to 36, and further comprising a second genetic modification increasing nicotine to nornicotine conversion. In an aspect, the present disclosure provides a tobacco plant, or part thereof, comprising a first genetic modification providing mutagenic or transgenic suppression of one or more, two or more, three or more, four or more, five or more, six or more genes encoding a polypeptide sequence having at least 90% identity to SEQ ID Nos: 20 to 29 and 37 to 43, and further comprising a second genetic modification increasing nicotine to nornicotine conversion. In a further aspect, a tobacco plant further optionally comprises another genetic modification increasing the level of one or more antioxidants.

BRIEF DESCRIPTION OF THE SEQUENCES

SEQ ID NOs: 1 and 5 set forth exemplary coding and polypeptide sequences of a Cytochrome P450 monooxygenase CYP82E4v2 gene from *Nicotiana tabacum.*

SEQ ID NOs: 2 and 6 set forth exemplary coding and polypeptide sequences of a *Nicotiana tabacum* Myb3 gene.

SEQ ID NOs: 3 and 7 set forth exemplary coding and polypeptide sequences of an *Arabidopsis thaliana* PAP1 gene.

SEQ ID NOs: 4 and 8 set forth exemplary coding and polypeptide sequences of a *Solanum tuberosum* AN1.

SEQ ID NO: 9 sets forth a sequence of the Nic1b Region.

SEQ ID NOs: 10 to 19 set forth exemplary genomic sequences of Nic1b_ERF genes as listed in Table 8.

SEQ ID NOs: 20 to 29 set forth exemplary genomic sequences of Nic1b_ERF genes as listed in Table 8.

SEQ ID NOs: 30 to 36 set forth exemplary genomic sequences of Nic2_ERF genes as listed in Table 9.

SEQ ID NOs: 37 to 43 set forth exemplary genomic sequences of Nic2_ERF genes as listed in Table 9.

SEQ ID NO: 44 sets forth an exemplary construct harboring two stacked expression cassettes for expressing both NtMYB3 and NtCYP82E4 (CsVMV-NtMYB3-Nos-T-CsVMV-CYP82E4-Nos-T).

SEQ ID NO: 45 sets forth the amino acid sequence of the 6×HIS tag.

Various sequences may include "N" in nucleotide sequences or "X" in amino acid sequences. "N" can be any nucleotide, e.g., A, T, G, C, or a deletion or insertion of one or more nucleotides. In some instant, a string of "N" are shown. The number of "N" does not necessarily correlate with the actual number of undetermined nucleotides at that position. The actual nucleotide sequences can be longer or shorter than the shown segment of "N". Similarly, "X" can be any amino acid residue or a deletion or insertion of one or more amino acids. Again, the number of "X" does not necessarily correlate with the actual number of undetermined amino acids at that position. The actual amino acid sequences can be longer or shorter than the shown segment of "X". Notwithstanding the use of A, T, G, C (compared to A, U, G, C) in describing any SEQ ID in the sequence listing, that SEQ ID can also refer to a RNA sequence, depending on the context in which the SEQ ID is mentioned.

DETAILED DESCRIPTION

Figure 1:
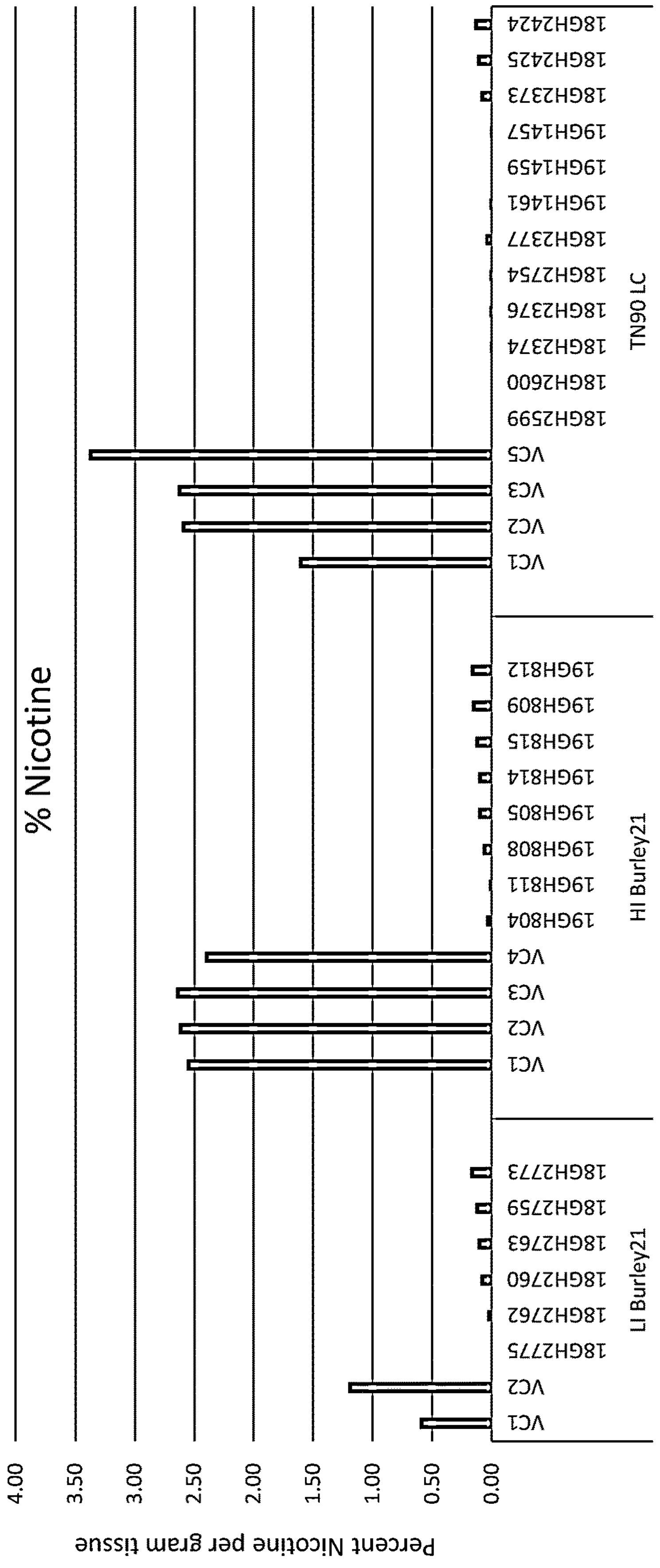
FIG. 1: Nicotine levels in greenhouse-grown $T_0$ transgenic plants overexpressing nicotine demethylase CYP82E4v2.

Unless defined otherwise, technical and scientific terms used herein have the same meaning as commonly understood by one of ordinary skill in the art. One skilled in the art will recognize many methods can be used in the practice of the present disclosure. Indeed, the present disclosure is in no way limited to the methods and materials described. For purposes of the present disclosure, the following terms are defined below.

Any references cited herein, including, e.g., all patents and publications are incorporated by reference in their entirety and to the same extent as if each individual publication, patent, or patent application is specifically and individually indicated to be incorporated by reference.

As used herein, the singular form "a," "an," and "the" include plural references unless the context clearly dictates otherwise. For example, the term "a compound" or "at least one compound" may include a plurality of compounds, including mixtures thereof. Where a term is provided in the singular, the inventors also contemplate aspects of the disclosure described by the plural of that term, and vice versa. Where there are discrepancies in terms and definitions used in references that are incorporated by reference, the terms used in this application shall have the definitions given herein. Other technical terms used have their ordinary meaning in the art in which they are used, as exemplified by various art-specific dictionaries, for example, "The American Heritage® Science Dictionary" (Editors of the American Heritage Dictionaries, 2011, Houghton Mifflin Harcourt, Boston and New York), the "McGraw-Hill Dictionary of Scientific and Technical Terms" (6th edition, 2002, McGraw-Hill, New York), or the "Oxford Dictionary of Biology" (6th edition, 2008, Oxford University Press, Oxford and New York).

When a grouping of alternatives is presented, any and all combinations of the members that make up that grouping of alternatives is specifically envisioned. For example, if an item is selected from a group consisting of A, B, C, and D, the inventors specifically envision each alternative individually (e.g., A alone, B alone, etc.), as well as combinations such as A, B, and D; A and C; B and C; etc. The term "and/or" when used in a list of two or more items means any one of the listed items by itself or in combination with any one or more of the other listed items. For example, the expression "A and/or B" is intended to mean either or both of A and B—i.e., A alone, B alone, or A and B in combination. The expression "A, B and/or C" is intended to mean A alone, B alone, C alone, A and B in combination, A and C in combination, B and C in combination, or A, B, and C in combination.

When a range of numbers is provided herein, the range is understood to inclusive of the edges of the range as well as any number between the defined edges of the range. For example, "between 1 and 10" includes any number between 1 and 10, as well as the number 1 and the number 10.

The term "about" is used herein to mean approximately, roughly, around, or in the region of (e.g., within 10%). When the term "about" is used in conjunction with a numerical range, it modifies that range by extending the boundaries above and below the numerical values set forth.

As used herein, any adverb, preposition, or other modifier phrase (e.g., about, less than, more than, at least, at most) used in conjunction with a string or group of alternatives (e.g., either quantitative or qualitative descriptors) modifies the entire string or group including each and every listed member of such string or group, regardless whether the adverb, preposition, or other modifier phrase is reproduced prior to each and every member.

As used herein, a "Nic1b locus" or "NIC1b locus" refers to any chromosomal position or location within or closely linked to the Nic1b Region. "Nic1b Region" refers to a chromosomal segment of about 1.5 million bps long, corresponding to SEQ ID No. 9 from a TN90 genome, and having allele(s) associated with a low-alkaloid trait. Nic1b Region is described in U.S. application Ser. Nos. 16/246,281 and 16/246,308, both filed Jan. 11, 2019; and PCT Applications Nos. PCT/US2019/013345 and PCT/US2019/013363, both filed Jan. 11, 2019, all of which are incorporated by reference in their entirety. A "nic1b mutation" refers to a mutation in a Nic1b locus.

As used herein, Nic1b_ERF (or the plural form, Nic1b_ERFs) refers to any one of ERF genes or loci at or near a Nic1b locus, and includes, for example, ERF101, ERF110, ERFnew, ERF199, ERF19, ERF130, ERF16, ERF29, ERF210, and ERF91L2. See Table 8 and Kajikawa et al., *Plant physiol.* 2017, 174:999-1011. A "nic1b_erf mutation" refers to a mutation in a Nic1b_ERF gene. As used herein, a mutation or mutant allele is shown in all lower-case and italic. Gene, locus, or protein names are shown in all upper-case or starting with a upper case, and may be italicized or non-italicized.

As used herein, Nic2_ERF (or the plural form, Nic2_ERFs) refers to any one of ERF genes or loci at or near a Nic2 locus, and includes, for example, ERF221, ERF115, ERF168, ERF17, ERF179, ERF189. See Table 9; Shoji et al., *Plant Cell*, (10):3390-409 (2010); and Kajikawa et al., *Plant physiol.* 2017, 174:999-1011.

TABLE 8

Selected ERF genes at or near Nic1b Region. The genomic coordinates of each ERF gene are shown as Start and Stop on Chromosome 7. The ERF nomenclature is based on Rushton et al., TOBFAC: the database of tobacco transcription factors, *BMC Bioinformatics* 2008, 9: 53. The DNA sequence of each of the Nic1b_ERF is obtained from a TobFac data set, and used to probe a tobacco genome database to identify both annotated gene models, transcripts, and chromosome coordinates. Sequence identification numbers (SEQ ID Nos.) are provided for exemplary genomic coding DNA sequences (including intron(s) if applicable) and polypeptide sequences for each of the genes.

| Nic1b_ERF Genes | Gene Models | Start on Chr 7 | Stop on Chr 7 | SEQ ID (gDNA) | SEQ ID (polypeptide) |
|---|---|---|---|---|---|
| ERF101 | g31383 | 79268220 | 79268714 | 10 | 20 |
| ERF110 | PB19937 | 80719601 | 80718555 | 11 | 21 |
| ERFnew | g31420 | 80937073 | 80937738 | 12 | 22 |
| ERF199 | g31430 | 81460624 | 81461723 | 13 | 23 |
| ERF19 | g31431 | 81636848 | 81635930 | 14 | 24 |
| ERF130 | ERFX | 81730359 | 81731329 | 15 | 25 |
| ERF16 | ERFY | 81737110 | 81736524 | 16 | 26 |
| ERF29 | g31435 | 81752464 | 81753174 | 17 | 27 |
| ERF210 | g31436 | 81848001 | 81849291 | 18 | 28 |
| ERF91L2 | g31437 | 81862817 | 81861981 | 19 | 29 |

TABLE 9

Selected ERF genes at or near Nic2 region. The genomic coordinates of each ERF gene are shown as Start and Stop on Chromosome 19. The ERF nomenclature is based on Rushton et al., TOBFAC: the database of tobacco transcription factors, *BMC Bioinformatics* 2008, 9: 53; Shoji et al., *Plant Cell*, (10): 3390-409 (2010); and Kajikawa et al.,, *Plant physiol.* 2017, 174: 999-1011. The DNA sequence of each of the Nic2_ERF is obtained from a TobFac data set or from the NCBI database, and used to probe a tobacco genome database to identify both annotated gene models, transcripts, and chromosome coordinates. Sequence identification numbers (SEQ ID Nos.) are provided for exemplary genomic coding DNA sequences (including intron(s) if applicable) and polypeptide sequences for each of the genes.

| Nic2_ERF Genes | Start on Chr 19 | Stop on Chr 19 | SEQ ID (gDNA) | SEQ ID (polypeptide) |
|---|---|---|---|---|
| ERF189 | 148554599 | 148553901 | 30 | 37 |
| ERF179 | 148680850 | 148679678 | 31 | 38 |
| ERF17 | 148753080 | 148753607 | 32 | 39 |
| ERF168 | 148760173 | 148758997 | 33 | 40 |
| ERF115 | 148902094 | 148903201 | 34 | 41 |
| ERF104 | 148990254 | 148989572 | 35 | 42 |
| ERF221 | 149009545 | 149008422 | 36 | 43 |

As used herein, a "genetic modification" refers to a change in the genetic makeup of a plant or plant genome. A genetic modification can be introduced by methods including, but not limited to, mutagenesis, genome editing, genetic transformation, or a combination thereof. A genetic modification includes, for example, a mutation (e.g., a non-natural mutation) in a gene or a transgene targeting a gene. As used here, "targeting" refers to either directly upregulating or directly downregulating the expression or activity of a gene. As used here, "directly", in the context of a transgene impacting the expression or activity of a gene, refers to the impact being exerted over the gene via a physical contact or chemical interaction between the gene (e.g., a promoter region or a UTR region) or a product encoded therein (e.g., a mRNA molecule or a polypeptide) and a product encoded by the transgene (e.g., a small non-coding RNA molecule or a protein such as a transcription factor or a dominant negative polypeptide variant). In an aspect, a transgene impacts the expression or activity of a target gene without involving a transcription factor (e.g., the transgene does not encode a transcription factor and/or does not suppress the expression or activity of a transcription factor that in turn regulates the target gene).

As used herein, a mutation refers to an inheritable genetic modification introduced into a gene to alter the expression or activity of a product encoded by the gene. Such a modification can be in any sequence region of a gene, for example, in a promoter, 5' UTR, exon, intron, 3' UTR, or terminator region. In an aspect, a mutation reduces, inhibits, or eliminates the expression or activity of a gene product. In another aspect, a mutation increases, elevates, strengthens, or augments the expression or activity of a gene product. In an aspect, mutations are not natural polymorphisms that exist in a particular tobacco variety or cultivar. As used herein, a "mutant allele" refers to an allele from a locus where the allele comprises a mutation. As used herein, "mutagenic" refers to generating a mutation without involving a transgene or with no mutation-related transgene remaining in an eventual mutant. In an aspect, mutagenic is cisgenic. In another aspect, mutagenic is via gene or genome editing. In a further aspect, mutagenic is via random mutagenesis, for example, chemical (e.g., EMS) or physical (r-irradiation) mutagenesis. It will be appreciated that, when identifying a mutation, the reference sequence should be from the same tobacco variety or background. For example, if a modified tobacco plant comprising a mutation is from the variety TN90, then the corresponding reference sequence should be the endogenous TN90 sequence, not a homologous sequence from a different tobacco variety (e.g., K326). In an aspect, a mutation is a "non-natural" or "non-naturally occurring" mutation. As used herein, a "non-natural" or "non-naturally occurring" mutation refers to a mutation that is not, and does not correspond to, a spontaneous mutation generated without human intervention. Non-limiting examples of human intervention include mutagenesis (e.g., chemical mutagenesis, ionizing radiation mutagenesis) and targeted genetic modifications (e.g., CRISPR-based methods, TALEN-based methods, zinc finger-based methods). Non-natural mutations and non-naturally occurring mutations do not include spontaneous mutations that arise naturally (e.g., via aberrant DNA replication in a germ line of a plant.

As used herein, a tobacco plant can be from any plant from the *Nicotiana* genus including, but not limited to *Nicotiana tabacum, Nicotiana amplexicaulis* PI 271989; *Nicotiana benthamiana* PI 555478; *Nicotiana bigelovii* PI 555485; *Nicotiana debneyi; Nicotiana excelsior* PI 224063; *Nicotiana glutinosa* PI 555507; *Nicotiana goodspeedii* PI 241012; *Nicotiana gossei* PI 230953; *Nicotiana hesperis* PI 271991; *Nicotiana knightiana* PI 555527; *Nicotiana maritima* PI 555535; *Nicotiana megalosiphon* PI 555536; *Nicotiana nudicaulis* PI 555540; *Nicotiana paniculata* PI 555545; *Nicotiana plumbaginifolia* PI 555548; *Nicotiana repanda* PI 555552; *Nicotiana rustica; Nicotiana suaveolens* PI 230960; *Nicotiana sylvestris* PI 555569; *Nicotiana tomentosa* PI 266379; *Nicotiana tomentosiformis*; and *Nicotiana trigonophylla* PI 555572. In an aspect, a tobacco plant described here is a *Nicotiana tabacum* plant.

In an aspect, the present disclosure provides a tobacco plant, or part thereof, comprising a first genetic modification suppressing one or more genes from a NIC1b locus, a NIC2 locus, or both, and further comprising a second genetic modification increasing nicotine to nornicotine conversion. In an aspect, a tobacco plant, or part thereof, comprises a mutation in a Nic1b locus. In an aspect, a Nic1b locus comprises genes selected from the group consisting of ERF101, ERF110, ERFnew, ERF199, ERF19, ERF130, ERF16, ERF29, ERF210, and ERF91L2. In an aspect, a tobacco plant comprises one or more mutations in two or more, three or more, four or more, five or more, six or more, or all seven genes selected from the group consisting of ERFnew, ERF199, ERF16, ERF19, ERF29, ERF210, and ERF91L2. In an aspect, a tobacco plant comprises one or more mutations in ERFnew, ERF16, or both. In an aspect, a first genetic modification comprises a transgene or mutation decreasing the expression or activity of one or more non-ERF genes from a NIC1b locus. In an aspect, a tobacco plant, or part thereof, comprises a mutation in a Nic2 locus. In an aspect, a Nic2 locus comprises genes selected from the group consisting of ERF189, ERF115, ERF221, ERF104, ERF179, ERF17, and ERF168. In an aspect, a tobacco plant comprises one or more mutations in two or more, three or more, four or more, five or more, six or more, or all seven genes selected from the group consisting of ERF189, ERF115, ERF221, ERF104, ERF179, ERF17, and ERF168. In an aspect, a tobacco plant comprises one or more mutations in ERF189, ERF115, or both. In a further aspect, a tobacco plant comprises one or more transgenes encoding a nicotine demethylase (e.g. CYP82E4, CYP82E5, CYP82E10). In a further aspect, a tobacco plant comprises one or more transgenes capable of expressing a nicotine demethylase (e.g. CYP82E4, CYP82E5, CYP82E10) when in a plant cell. In a further aspect, a tobacco plant comprises one or more transgenes encoding a nicotine demethylase CYP82E4v2. In a further aspect, a tobacco plant comprises one or more transgenes capable of expressing a nicotine demethylase CYP82E4v2.

In an aspect, a tobacco plant further comprises one or more transgenes encoding an antioxidant regulatory protein (e.g. *Arabidopsis thaliana* PAP1, *Solanum tuberosum* AN1, *Nicotiana tabacum* Myb3). In an aspect, a tobacco plant further comprises one or more transgenes capable of expressing an antioxidant regulatory protein (e.g. *Arabidopsis thaliana* PAP1, *Solanum tuberosum* AN1, *Nicotiana tabacum* Myb3).

In an aspect, the present disclosure provides a tobacco plant, or part thereof, comprising a first genetic modification providing mutagenic or transgenic suppression of one or more, two or more, three or more, four or more, five or more, six or more genes comprising a nucleotide sequence having at least 85%, 90%, 95%, 97%, 99% identity to SEQ ID Nos: 10 to 19 and 30 to 36, and further comprising a second genetic modification increasing nicotine to nornicotine conversion. In an aspect, the present disclosure provides a tobacco plant, or part thereof, comprising a first genetic modification providing mutagenic or transgenic suppression of one or more, two or more, three or more, four or more, five or more, six or more genes encoding a polypeptide sequence having at least 85%, 90%, 95%, 97%, 99% identity to SEQ ID Nos: 20 to 29 and 37 to 43, and further comprising a second genetic modification increasing nicotine to nornicotine conversion. In a further aspect, a tobacco plant further optionally comprises another genetic modification increasing the level of one or more antioxidants.

In an aspect, a tobacco plant of the present disclosure comprises a mutation in a Nic1b or Nic2 locus (e.g., one or more Nic1b_ERF or Nic2_ERF genes), one or more transgenes encoding a nicotine demethylase, and one or more transgenes encoding an antioxidant regulatory protein. In an aspect, a tobacco plant of the present disclosure comprises a mutation in a Nic1b or Nic2 locus (e.g., one or more Nic1b_ERF or Nic2_ERF genes), one or more transgenes capable of expressing a nicotine demethylase, and one or more transgenes capable of expressing an antioxidant regulatory protein. In an aspect, a tobacco plant of the present disclosure comprises a mutation in a Nic1b or Nic2 locus (e.g., one or more Nic1b_ERF or Nic2_ERF genes), a transgene encoding *Arabidopsis thaliana* PAP1, and a transgene encoding the nicotine demethylase CYP82E4v2. In an aspect, a tobacco plant of the present disclosure comprises a mutation in a Nic1b or Nic2 locus (e.g., one or more Nic1b_ERF or Nic2_ERF genes), a transgene encoding *Solanum tuberosum* AN1, and a transgene encoding the nicotine demethylase CYP82E4v2. In an aspect, a tobacco plant of the present disclosure comprises a mutation in a Nic1b or Nic2 locus (e.g., one or more Nic1b_ERF or Nic2_ERF genes), a transgene encoding *Nicotiana tabacum* Myb3, and a transgene encoding the nicotine demethylase CYP82E4v2. In an aspect, a tobacco plant of the present disclosure comprises a mutation in a Nic1b or Nic2 locus (e.g., one or more Nic1b_ERF or Nic2_ERF genes), a transgene encoding *Arabidopsis thaliana* PAP1, and a transgene encoding the nicotine demethylase CYP82E5. In an aspect, a tobacco plant of the present disclosure comprises a mutation in a Nic1b or Nic2 locus (e.g., one or more Nic1b_ERF or Nic2_ERF genes), a transgene encoding *Solanum tuberosum* AN1, and a transgene encoding the nicotine demethylase CYP82E5. In an aspect, a tobacco plant of the present disclosure comprises a mutation in a Nic1b or Nic2 locus (e.g., one or more Nic1b_ERF or Nic2_ERF genes), a transgene encoding *Nicotiana tabacum* Myb3, and a transgene encoding the nicotine demethylase CYP82E5. In an aspect, a tobacco plant of the present disclosure comprises a mutation in a Nic1b or Nic2 locus (e.g., one or more Nic1b_ERF or Nic2_ERF genes), a transgene encoding *Arabidopsis thaliana* PAP1, and a transgene encoding the nicotine demethylase CYP82E410. In an aspect, a tobacco plant of the present disclosure comprises a mutation in a Nic1b or Nic2 locus (e.g., one or more Nic1b_ERF or Nic2_ERF genes), a transgene encoding *Solanum tuberosum* AN1, and a transgene encoding the nicotine demethylase CYP82E10. In an aspect, a tobacco plant of the present disclosure comprises a mutation in a Nic1b or Nic2 locus (e.g., one or more Nic1b_ERF or Nic2_ERF genes), a transgene encoding *Nicotiana tabacum* Myb3, and a transgene encoding the nicotine demethylase CYP82E10.

In an aspect, a tobacco plant, or part thereof, of the present disclosure, comprises a first genetic modification suppressing one or more genes from a Nic1b or NIC2 locus and further comprising a second genetic modification increasing nicotine to nornicotine conversion. In a further aspect, a first genetic modification comprises a nic1b or nic2 mutant allele. In another aspect, a nic1b or nic2 mutant allele is derived from a Cuban cigar tobacco variety, Low-Alkaloid Burley 21 (LA BU21), Low-Alkaloid Flue-Cured 53 (LA FC53), Low-Nicotine KY171 (LN KY171), or a variety derived therefrom. In another aspect, a nic1b or nic2 mutant allele is not derived from a Cuban cigar tobacco variety, Low-Alkaloid Burley 21 (LA BU21), Low-Alkaloid Flue-Cured 53 (LA FC53), Low-Nicotine KY171 (LN KY171), or a variety derived therefrom. In another aspect, the first genetic modification comprises a transgene or mutation decreasing the expression or activity of one or more ethylene-response factor (ERF) genes from Nic1b or NIC2 locus. In an aspect, a transgene targets one or more genes selected from the group consisting of ERF101, ERF110, ERFnew, ERF199, ERF19, ERF130, ERF16, ERF29, ERF210, and ERF91L2. In a further aspect, a transgene targets one or more genes selected from the group consisting of ERF189, ERF115, ERF221, ERF104, ERF179, ERF17, and ERF168.

In an aspect, a tobacco plant, or part thereof, of the present disclosure comprises a genetic modification comprising a transgene encoding a nicotine demethylase. In another aspect, a transgene encodes a nicotine demethylase gene from a tobacco plant of the genus *Nicotiana*. In a further aspect, a nicotine demethylase comprises a non-natural, mutated, or engineered amino acid sequence.

In a further aspect, a genetic modification comprising a transgene encoding a nicotine demethylase overexpresses one or more of CYP82E4, CYP82E5, and CYP85E10 polypeptides. In a further aspect, a genetic modification comprises a genome edit increasing the expression or activity of one or more of CYP82E4, CYP82E5, and CYP85E10 polypeptides. In another aspect, a CYP82E4 nicotine demethylase is CYP82E4v2.

In a further aspect, a tobacco plant, or part thereof, of the present disclosure comprises a genetic modification increasing the level of one or more antioxidants compared to a control plant lacking that genetic modification. In a further aspect, the genetic modification comprises a transgene encoding or targeting an antioxidant biosynthetic enzyme, a regulatory transcription factor of an antioxidant, an antioxidant transporter, an antioxidant metabolic enzyme, or a combination thereof. In a further aspect, the genetic modification comprises a modification of one or more endogenous genes encoding an antioxidant biosynthetic enzyme, a regulatory transcription factor of an antioxidant, an antioxidant transporter, an antioxidant metabolic enzyme, or a combination thereof. In a further aspect, a tobacco plant comprises a transgene encoding one or more polypeptides selected from the group consisting of AtPAP1, Ntmyb3A, Ntmyb3B, Ntmyb3C, NtJAF13, StAN1, NtAN1, and NtAN2. See U.S. Patent Application publication US2018/0119163 incorporated herein by reference in its entirety.

In an aspect, a tobacco plant, or part thereof, of the present disclosure, comprises increased amounts of one or more antioxidants. In an aspect, an antioxidant with an increased amount is selected from the group consisting of anthocyanidin, flavanone, flavanol, flavone, flavonol, isoflavone, hydroxybenzoic acid, hydroxycinnamic acid, ellagitannin, stibene, lignan, carotenoids, and glycyrrhzin. In a further aspect, an antioxidant with an increased amount is selected from the group consisting of Delphinidin, Cyanidin, Procyanidin, Prodelphinidin, Hesperetin, Naringenin, Catechin, Epicatechin, Apigenin, Luteonin, Quercetin, Myricetin, Rutin, Genistein, Daidzein, Gallic acid, Vanillic acid, Protocatechuic acid, Ferunic acid, Cinnamic acid, Coumeric acid, Chlorogenic acid, Coffeic acid, ferulic acid, Sanguiin, Resveratrol, Sesamin, Caretonoids, and Vitamin C.

In an aspect, tobacco plants of the present disclosure are capable of producing leaves, when cured, having a USDA grade index value selected from the group consisting of 55 or more, 60 or more, 65 or more, 70 or more, 75 or more, 80 or more, 85 or more, 90 or more, and 95 or more. In another aspect, tobacco plants are capable of producing leaves, when cured, having a USDA grade index value comparable to that of a control plant when grown and cured in similar conditions, where the control plant shares an essentially identical genetic background with the tobacco plant except a mutation or modification of interest.

In a further aspect, tobacco plants of the present disclosure are capable of producing leaves, when cured, having a USDA grade index value of at least about 65%, at least about 70%, at least about 75%, at least about 80%, at least about 85%, at least about 90%, at least about 95%, or at least about 98% of the USDA grade index value of a control plant when grown in similar conditions, where the control plant shares an essentially identical genetic background with the tobacco plant except a mutation or modification of interest mutation.

In a further aspect, tobacco plants of the present disclosure are capable of producing leaves, when cured, having a USDA grade index value of between 65% and 130%, between 70% and 130%, between 75% and 130%, between 80% and 130%, between 85% and 130%, between 90% and 130%, between 95% and 130%, between 100% and 130%, between 105% and 130%, between 110% and 130%, between 115% and 130%, or between 120% and 130% of the USDA grade index value of the control plant. In a further aspect, tobacco plants are capable of producing leaves, when cured, having a USDA grade index value of between 70% and 125%, between 75% and 120%, between 80% and 115%, between 85% and 110%, or between 90% and 100% of the USDA grade index value of the control plant. In an aspect, a tobacco plant comprises nicotine at a level below 1%, below 2%, below 5%, below 8%, below 10%, below 12%, below 15%, below 20%, below 25%, below 30%, below 40%, below 50%, below 60%, below 70%, or below 80% of the nicotine level of a control plant when grown in similar growth conditions, where the control plant shares an essentially identical genetic background with the tobacco plant except a mutation or modification of interest mutation.

In an aspect, cured leaf from a modified tobacco plant produces or comprises less than 2, less than 1.8, less than 1.5, less than 1.2, less than 1.0, less than 0.8, less than 0.6, less than 0.4, less than 0.3, less than 0.2, less than 0.15, less than 0.1, or less than 0.05 ppm total TSNAs. In an aspect, cured leaf from a modified tobacco plant comprises between 2 and 0.05, between 1.8 and 0.05, between 1.5 and 0.05, between 1.2 and 0.05, between 1.0 and 0.05, between 0.8 and 0.05, between 0.6 and 0.05, between 0.4 and 0.05, between 0.3 and 0.05, between 0.2 and 0.05, between 0.15 and 0.05, or between 0.1 and 0.05 ppm total TSNAs. In an aspect, cured leaf from a modified tobacco plant comprises between 2 and 0.05, between 1.8 and 0.1, between 1.5 and 0.15, between 1.2 and 0.2, between 1.0 and 0.3, between 0.8 and 0.4, or between 0.6 and 0.5 ppm total TSNAs.

In an aspect, a modified tobacco plant produces or comprises less than 2, less than 1.8, less than 1.5, less than 1.2, less than 1.0, less than 0.8, less than 0.6, less than 0.4, less than 0.3, less than 0.2, less than 0.15, less than 0.1, or less than 0.05 ppm total NNN. In an aspect, cured leaf from a modified tobacco plant comprises between 2 and 0.05, between 1.8 and 0.05, between 1.5 and 0.05, between 1.2 and 0.05, between 1.0 and 0.05, between 0.8 and 0.05, between 0.6 and 0.05, between 0.4 and 0.05, between 0.3 and 0.05, between 0.2 and 0.05, between 0.15 and 0.05, or between 0.1 and 0.05 ppm total NNN. In an aspect, cured leaf from a modified tobacco plant comprises between 2 and 0.05, between 1.8 and 0.1, between 1.5 and 0.15, between 1.2 and 0.2, between 1.0 and 0.3, between 0.8 and 0.4, or between 0.6 and 0.5 ppm total NNN.

In an aspect, a modified tobacco plant produces or comprises less than 2, less than 1.8, less than 1.5, less than 1.2, less than 1.0, less than 0.8, less than 0.6, less than 0.4, less than 0.3, less than 0.2, less than 0.15, less than 0.1, or less than 0.05 ppm total NNK. In an aspect, cured leaf from a modified tobacco plant comprises between 2 and 0.05, between 1.8 and 0.05, between 1.5 and 0.05, between 1.2 and 0.05, between 1.0 and 0.05, between 0.8 and 0.05, between 0.6 and 0.05, between 0.4 and 0.05, between 0.3 and 0.05, between 0.2 and 0.05, between 0.15 and 0.05, or between 0.1 and 0.05 ppm total NNK. In an aspect, cured leaf from a modified tobacco plant comprises between 2 and 0.05, between 1.8 and 0.1, between 1.5 and 0.15, between 1.2 and 0.2, between 1.0 and 0.3, between 0.8 and 0.4, or between 0.6 and 0.5 ppm total NNK.

In another aspect, tobacco plants of the present disclosure comprise a total alkaloid level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%. In another aspect, a tobacco plant comprises a nicotine or total alkaloid level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%. In a further aspect, tobacco plants further comprises a transgene or mutation directly suppressing the expression or activity of one or more genes encoding a product selected from the group consisting of PMT, MPO, QPT, BBL, A622, aspartate oxidase, agmatine deiminase (AIC), arginase, diamine oxidase, ornithine decarboxylase, arginine decarboxylase, nicotine uptake permease (NUP), and MATE transporter.

In another aspect, tobacco plants are capable of producing leaves, when cured, having a USDA grade index value selected from the group consisting of 55 or more, 60 or more, 65 or more, 70 or more, 75 or more, 80 or more, 85 or more, 90 or more, and 95 or more. In another aspect, tobacco plants are capable of producing leaves, when cured, having a USDA grade index value selected from the group consisting of between 50 and 95, between 55 and 95, between 60 and 95, between 65 and 95, between 70 and 95, between 75 and 95, between 80 and 95, between 85 and 95, between 90 and 95, between 55 and 90, between 60 and 85, between 65 and 80, between 70 and 75, between 50 and 55, between 55 and 60, between 60 and 65, between 65 and 70, between 70 and 75, between 75 and 80, between 80 and 85, between 85 and 90, and between 90 and 95. In a further aspect, tobacco plants are capable of producing leaves, when cured, having a USDA grade index value of at least about 65%, at least about 70%, at least about 75%, at least about 80%, at least about 85%, at least about 90%, at least about 95%, or at least about 98% of the USDA grade index value of the control plant. In a further aspect, tobacco plants are capable of producing leaves, when cured, having a USDA grade index value of between 65% and 130%, between 70% and 130%, between 75% and 130%, between 80% and 130%, between 85% and 130%, between 90% and 130%, between 95% and 130%, between 100% and 130%, between 105% and 130%, between 110% and 130%, between 115% and 130%, or between 120% and 130% of the USDA grade index value of the control plant. In a further aspect, tobacco plants are capable of producing leaves, when cured, having a USDA grade index value of between 70% and 125%, between 75% and 120%, between 80% and 115%, between 85% and 110%, or between 90% and 100% of the USDA grade index value of the control plant. In another aspect, a tobacco plant comprises nicotine or total alkaloids at a level below 1%, below 2%, below 5%, below 8%, below 10%, below 12%, below 15%, below 20%, below 25%, below 30%, below 40%, below 50%, below 60%, below 70%, or below 80% of the nicotine or total alkaloids level of the control plant when grown in similar growth conditions. In another aspect, tobacco plants further comprises a transgene or mutation directly suppressing the expression or activity of one or more genes encoding a product selected from the group consisting of PMT, MPO, QPT, BBL, A622, aspartate oxidase, agmatine deiminase (AIC), arginase, diamine oxidase, ornithine decarboxylase, arginine decarboxylase, nicotine uptake permease (NUP), and MATE transporter.

In an aspect, the present disclosure also provides a tobacco variety, cultivar, or line comprising a nic1b or nic2 mutation, comprising a genetic modification increasing nicotine to nornicotine conversion, and further optionally comprising another genetic modification increasing the level of one or more antioxidants, where the tobacco variety, cultivar, or line has a leaf grade comparable to the leaf grade of a control tobacco variety, cultivar, or line when grown in similar growth conditions, where the control tobacco variety shares an essentially identical genetic background with the tobacco variety, cultivar, or line except a mutation or modification of interest.

In an aspect, the present disclosure provides a population of any tobacco plant disclosed herein.

In an aspect, the present disclosure provides cured tobacco material of any tobacco plant disclosed herein. In a further aspect, the present disclosure provides a tobacco blend comprising cured tobacco material of any tobacco plant disclosed herein. In a further aspect, the present disclosure provides tobacco products comprising cured tobacco material provided herein.

In a further aspect, a tobacco blend of cured tobacco material of the present disclosure constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in said tobacco blend by weight. In a further aspect, a tobacco blend of cured tobacco material of the present disclosure constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in said tobacco blend by volume.

In an aspect, a tobacco plant provided further comprises one or more transgenes that express one or more nicotine demethylase proteins (e.g., CYP82E4, CYP82E5, CYP82E10) that confer increased amounts of nornicotine (See U.S. Pat. Nos. 8,319,011; 8,124,851; 9,187,759; 9,228,194; 9,228,195; 9,247,706) compared to a control plant lacking one or more transgenes expressing a nicotine demethylase. In an aspect, a tobacco plant provided further comprises one or more transgenes encoding one or more nicotine demethylase proteins (e.g., CYP82E4, CYP82E5, CYP82E10) that confer increased amounts of nornicotine compared to a control plant lacking one or more transgenes encoding a nicotine demethylase. In an aspect, a modified tobacco plant described further comprises increased nicotine demethylase activity compared to a control plant when grown and cured under comparable conditions.

In an aspect, the present disclosure provides a modified tobacco plant capable of producing cured tobacco leaf comprising a reduced level of one or more tobacco-specific nitrosamines (TSNAs) and further comprising an increased level of one or more antioxidants, wherein the reduced and increased levels are compared to a control tobacco plant or cured leaf from a control tobacco plant of the same variety when grown and cured under comparable conditions. In an aspect, a reduced level of one or more TSNAs is less than 50% of the level of the one or more TSNAs in cured leaf from a control plant. In another aspect, a modified tobacco plant further comprises an increased level of oxygen radical absorbance capacity (ORAC) compared to a control tobacco plant when grown and cured under comparable conditions.

In another aspect, cured leaf from a modified tobacco plant comprises a reduced level of total TSNAs compared to the cured leaf from a control tobacco plant when grown and cured under comparable conditions. In an aspect, reduced one or more TSNAs are selected from the group consisting of N'-nitrosonornicotine (NNN), 4-methylnitrosoamino-1-(3-pyridyl)-1-butanone (NNK), N'-nitrosoanatabine (NAT) N'-nitrosoanabasine (NAB), and any combination thereof. In an aspect, the level of total TSNAs or an individual TSNA is measured based on a freeze-dried cured leaf sample using liquid chromatography with tandem mass spectrometry (LC/MS/MS).

In an aspect, the present disclosure provides tobacco plants comprising at least one mutation in a Nic1b or Nic2 locus (e.g., one or more Nic1b_ERF or Nic2_ERF genes) and a transgene comprising a sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% homology to SEQ ID NO:1. In an aspect, the present disclosure provides tobacco plants comprising at least one mutation in a Nic1b or Nic2 locus (e.g., one or more Nic1b_ERF or Nic2_ERF genes) and a transgene comprising a sequence with at least 70% homology to SEQ ID NO:1. In an aspect, the transgene comprises a sequence with at least 75% homology to SEQ ID NO:1. In an aspect, the transgene comprises a sequence with at least 80% homology to SEQ ID NO:1. In an aspect, the transgene comprises a sequence with at least 85% homology to SEQ ID NO:1. In an aspect, the transgene comprises a sequence with at least 90% homology to SEQ ID NO:1. In an aspect, the transgene comprises a sequence with at least 91% homology to SEQ ID NO:1. In an aspect, the transgene comprises a sequence with at least 92% homology to SEQ ID NO:1. In an aspect, the transgene comprises a sequence with at least 93% homology to SEQ ID NO:1. In an aspect, the transgene comprises a sequence with at least 94% homology to SEQ ID NO:1. In an aspect, the transgene comprises a sequence with at least 95% homology to SEQ ID NO:1. In an aspect, the transgene comprises a sequence with at least 96% homology to SEQ ID NO:1. In an aspect, the transgene comprises a sequence with at least 97% homology to SEQ ID NO:1. In an aspect, the transgene comprises a sequence with at least 98% homology to SEQ ID NO:1. In an aspect, the transgene comprises a sequence with at least 99% homology to SEQ ID NO:1. In an aspect, the transgene comprises a sequence with at least 100% homology to SEQ ID NO:1.

In an aspect, the present disclosure provides tobacco plants comprising at least one mutation in a Nic1b or Nic2 locus (e.g., one or more Nic1b_ERF or Nic2_ERF genes) and a transgene comprising a sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% homology to SEQ ID NO:1 and further comprising a second transgene comprising a sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% homology to SEQ ID NO:2.

In an aspect, the present disclosure provides tobacco plants comprising at least one mutation in a Nic1b or Nic2 locus (e.g., one or more Nic1b_ERF or Nic2_ERF genes) and a transgene comprising a sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% homology to SEQ ID NO:1 and further comprising a second transgene comprising a sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% homology to SEQ ID NO:3.

In an aspect, the present disclosure provides tobacco plants comprising at least one mutation in a Nic1b or Nic2 locus (e.g., one or more Nic1b_ERF or Nic2_ERF genes) and a transgene comprising a sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% homology to SEQ ID NO:1 and further comprising a second transgene comprising a sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% homology to SEQ ID NO:4.

In an aspect, the present disclosure provides tobacco plants comprising at least one mutation in a Nic1b or Nic2 locus (e.g., one or more Nic1b_ERF or Nic2_ERF genes) and a transgene comprising SEQ ID NO:1 and further comprising a second transgene comprising a sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% homology to SEQ ID NO:2.

In an aspect, the present disclosure provides tobacco plants comprising at least one mutation in a Nic1b or Nic2 locus (e.g., one or more Nic1b_ERF or Nic2_ERF genes) and a transgene comprising SEQ ID NO:1 and further comprising a second transgene comprising a sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% homology to SEQ ID NO:3.

In an aspect, the present disclosure provides tobacco plants comprising at least one mutation in a Nic1b or Nic2 locus (e.g., one or more Nic1b_ERF or Nic2_ERF genes) and a transgene comprising SEQ ID NO:1 and further comprising a second transgene comprising a sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% homology to SEQ ID NO:4.

In an aspect, the present disclosure provides tobacco plants comprising at least one mutation in a Nic1b or Nic2 locus (e.g., one or more Nic1b_ERF or Nic2_ERF genes) and a transgene comprising SEQ ID NO:1 and further comprising a second transgene comprising a sequence with at least 70% homology to SEQ ID NO:2. In a further aspect, the tobacco plant comprises a transgene comprising SEQ ID NO:1 and further comprises a second transgene comprising a sequence with at least 75% homology to SEQ ID NO:2. In a further aspect, the tobacco plant comprises a transgene comprising SEQ ID NO:1 and further comprises a second transgene comprising a sequence with at least 80% homology to SEQ ID NO:2. In a further aspect, the tobacco plant comprises a transgene comprising SEQ ID NO:1 and further comprises a second transgene comprising a sequence with at least 85% homology to SEQ ID NO:2. In a further aspect, the tobacco plant comprises a transgene comprising SEQ ID NO:1 and further comprises a second transgene comprising a sequence with at least 90% homology to SEQ ID NO:2. In a further aspect, the tobacco plant comprises a transgene comprising SEQ ID NO:1 and further comprises a second transgene comprising a sequence with at least 91% homology to SEQ ID NO:2. In a further aspect, the tobacco plant comprises a transgene comprising SEQ ID NO:1 and further comprises a second transgene comprising a sequence with at least 92% homology to SEQ ID NO:2. In a further aspect, the tobacco plant comprises a transgene comprising SEQ ID NO:1 and further comprises a second transgene comprising a sequence with at least 93% homology to SEQ ID NO:2. In a further aspect, the tobacco plant comprises a transgene comprising SEQ ID NO:1 and further comprises a second transgene comprising a sequence with at least 94% homology to SEQ ID NO:2. In a further aspect, the tobacco plant comprises a transgene comprising SEQ ID NO:1 and further comprises a second transgene comprising a sequence with at least 95% homology to SEQ ID NO:2. In a further aspect, the tobacco plant comprises a transgene comprising SEQ ID NO:1 and further comprises a second transgene comprising a sequence with at least 96% homology to SEQ ID NO:2. In a further aspect, the tobacco plant comprises a transgene comprising SEQ ID NO:1 and further comprises a second transgene comprising a sequence with at least 97% homology to SEQ ID NO:2. In a further aspect, the tobacco plant comprises a transgene comprising SEQ ID NO:1 and further comprises a second transgene comprising a sequence with at least 98% homology to SEQ ID NO:2. In a further aspect, the tobacco plant comprises a transgene comprising SEQ ID NO:1 and further comprises a second transgene comprising a sequence with at least 99% homology to SEQ ID NO:2. In a further aspect, the tobacco plant comprises a transgene comprising SEQ ID NO:1 and further comprises a second transgene comprising a sequence with at least 100% homology to SEQ ID NO:2.

In an aspect, the present disclosure provides tobacco plants comprising at least one mutation in a Nic1b or Nic2 locus (e.g., one or more Nic1b_ERF or Nic2_ERF genes) and a transgene comprising SEQ ID NO:1 and further comprising a second transgene comprising a sequence with at least 70% homology to SEQ ID NO:3. In a further aspect, the tobacco plant comprises a transgene comprising SEQ ID NO:1 and further comprises a second transgene comprising a sequence with at least 75% homology to SEQ ID NO:3. In a further aspect, the tobacco plant comprises a transgene comprising SEQ ID NO:1 and further comprises a second transgene comprising a sequence with at least 80% homology to SEQ ID NO:3. In a further aspect, the tobacco plant comprises a transgene comprising SEQ ID NO:1 and further comprises a second transgene comprising a sequence with at least 85% homology to SEQ ID NO:3. In a further aspect, the tobacco plant comprises a transgene comprising SEQ ID NO:1 and further comprises a second transgene comprising a sequence with at least 90% homology to SEQ ID NO:3. In a further aspect, the tobacco plant comprises a transgene comprising SEQ ID NO:1 and further comprises a second transgene comprising a sequence with at least 91% homology to SEQ ID NO:3. In a further aspect, the tobacco plant comprises a transgene comprising SEQ ID NO:1 and further comprises a second transgene comprising a sequence with at least 92% homology to SEQ ID NO:3. In a further aspect, the tobacco plant comprises a transgene comprising SEQ ID NO:1 and further comprises a second transgene comprising a sequence with at least 93% homology to SEQ ID NO:3. In a further aspect, the tobacco plant comprises a transgene comprising SEQ ID NO:1 and further comprises a second transgene comprising a sequence with at least 94% homology to SEQ ID NO:3. In a further aspect, the tobacco plant comprises a transgene comprising SEQ ID NO:1 and further comprises a second transgene comprising a sequence with at least 95% homology to SEQ ID NO:3. In a further aspect, the tobacco plant comprises a transgene comprising SEQ ID NO:1 and further comprises a second transgene comprising a sequence with at least 96% homology to SEQ ID NO:3. In a further aspect, the tobacco plant comprises a transgene comprising SEQ ID NO:1 and further comprises a second transgene comprising a sequence with at least 97% homology to SEQ ID NO:3. In a further aspect, the tobacco plant comprises a transgene comprising SEQ ID NO:1 and further comprises a second transgene comprising a sequence with at least 98% homology to SEQ ID NO:3. In a further aspect, the tobacco plant comprises a transgene comprising SEQ ID NO:1 and further comprises a second transgene comprising a sequence with at least 99% homology to SEQ ID NO:3. In a further aspect, the tobacco plant comprises a transgene comprising SEQ ID NO:1 and further comprises a second transgene comprising a sequence with at least 100% homology to SEQ ID NO:3.

In an aspect, the present disclosure provides tobacco plants comprising at least one mutation in a Nic1b or Nic2 locus (e.g., one or more Nic1b_ERF or Nic2_ERF genes) and a transgene comprising SEQ ID NO:1 and further comprising a second transgene comprising a sequence with at least 70% homology to SEQ ID NO:4. In a further aspect, the tobacco plant comprises a transgene comprising SEQ ID NO:1 and further comprises a second transgene comprising a sequence with at least 75% homology to SEQ ID NO:4. In a further aspect, the tobacco plant comprises a transgene comprising SEQ ID NO:1 and further comprises a second transgene comprising a sequence with at least 80% homology to SEQ ID NO:4. In a further aspect, the tobacco plant comprises a transgene comprising SEQ ID NO:1 and further comprises a second transgene comprising a sequence with at least 85% homology to SEQ ID NO:4. In a further aspect, the tobacco plant comprises a transgene comprising SEQ ID NO:1 and further comprises a second transgene comprising a sequence with at least 90% homology to SEQ ID NO:4. In a further aspect, the tobacco plant comprises a transgene comprising SEQ ID NO:1 and further comprises a second transgene comprising a sequence with at least 91% homology to SEQ ID NO:4. In a further aspect, the tobacco plant comprises a transgene comprising SEQ ID NO:1 and further comprises a second transgene comprising a sequence with at least 92% homology to SEQ ID NO:4. In a further aspect, the tobacco plant comprises a transgene comprising SEQ ID NO:1 and further comprises a second transgene comprising a sequence with at least 93% homology to SEQ ID NO:4. In a further aspect, the tobacco plant comprises a transgene comprising SEQ ID NO:1 and further comprises a second transgene comprising a sequence with at least 94% homology to SEQ ID NO:4. In a further aspect, the tobacco plant comprises a transgene comprising SEQ ID NO:1 and further comprises a second transgene comprising a sequence with at least 95% homology to SEQ ID NO:4. In a further aspect, the tobacco plant comprises a transgene comprising SEQ ID NO:1 and further comprises a second transgene comprising a sequence with at least 96% homology to SEQ ID NO:4. In a further aspect, the tobacco plant comprises a transgene comprising SEQ ID NO:1 and further comprises a second transgene comprising a sequence with at least 97% homology to SEQ ID NO:4. In a further aspect, the tobacco plant comprises a transgene comprising SEQ ID NO:1 and further comprises a second transgene comprising a sequence with at least 98% homology to SEQ ID NO:4. In a further aspect, the tobacco plant comprises a transgene comprising SEQ ID NO:1 and further comprises a second transgene comprising a sequence with at least 99% homology to SEQ ID NO:4. In a further aspect, the tobacco plant comprises a transgene comprising SEQ ID NO:1 and further comprises a second transgene comprising a sequence with at least 100% homology to SEQ ID NO:4.

In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% identity to SEQ ID NO:5. In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein sequence with at least 70% identity to SEQ ID NO:5. In an aspect, the transgene comprises a nucleotide sequence encoding a protein sequence with at least 75% identity to SEQ ID NO:5. In an aspect, the transgene comprises a nucleotide sequence encoding a protein sequence with at least 80% identity to SEQ ID NO:5. In an aspect, the transgene comprises a nucleotide sequence encoding a protein sequence with at least 85% identity to SEQ ID NO:5. In an aspect, the transgene comprises a nucleotide sequence encoding a protein sequence with at least 90% identity to SEQ ID NO:5. In an aspect, the transgene comprises a nucleotide sequence encoding a protein sequence with at least 91% identity to SEQ ID NO:5. In an aspect, the transgene comprises a nucleotide sequence encoding a protein sequence with at least 92% identity to SEQ ID NO:5. In an aspect, the transgene comprises a nucleotide sequence encoding a protein sequence with at least 93% identity to SEQ ID NO:5. In an aspect, the transgene comprises a nucleotide sequence encoding a protein sequence with at least 94% identity to SEQ ID NO:5. In an aspect, the transgene comprises a nucleotide sequence encoding a protein sequence with at least 95% identity to SEQ ID NO:5. In an aspect, the transgene comprises a nucleotide sequence encoding a protein sequence with at least 96% identity to SEQ ID NO:5. In an aspect, the transgene comprises a nucleotide sequence encoding a protein sequence with at least 97% identity to SEQ ID NO:5. In an aspect, the transgene comprises a nucleotide sequence encoding a protein sequence with at least 98% identity to SEQ ID NO:5. In an aspect, the transgene comprises a nucleotide sequence encoding a protein sequence with at least 99% identity to SEQ ID NO:5. In an aspect, the transgene comprises a nucleotide sequence encoding a protein sequence with at least 100% identity to SEQ ID NO:5.

In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% identity to SEQ ID NO:5 and further comprising a second transgene comprising a nucleotide sequence encoding a protein with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% identity to SEQ ID NO:6.

In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% identity to SEQ ID NO:5 and further comprising a second transgene comprising a nucleotide sequence encoding a protein with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% identity to SEQ ID NO:7.

In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% identity to SEQ ID NO:5 and further comprising a second transgene comprising a nucleotide sequence encoding a protein with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% identity to SEQ ID NO:8.

In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein with an amino acid sequence of SEQ ID NO:5 and further comprising a second transgene comprising a nucleotide sequence encoding a protein with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% identity to SEQ ID NO:6.

In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein with an amino acid sequence of SEQ ID NO:5 and further comprising a second transgene comprising a nucleotide sequence encoding a protein sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% identity to SEQ ID NO:7.

In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein with an amino acid sequence of SEQ ID NO:5 and further comprising a second transgene comprising a nucleotide sequence encoding a protein sequence with at least 70%, at least 75%, at least 80%, at least 85%, at least 90%, at least 91%, at least 92%, at least 93%, at least 94%, at least 95%, at least 96%, at least 97%, at least 98%, at least 99%, or at least 100% identity to SEQ ID NO:8.

In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein with an amino acid sequence of SEQ ID NO:5 and further comprising a second transgene comprising a nucleotide sequence encoding a protein sequence with at least 70% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 75% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 80% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 85% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 90% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 91% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 92% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 93% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 94% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 95% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 96% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 97% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 98% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 99% identity to SEQ ID NO:6. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 100% identity to SEQ ID NO:6.

In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein with an amino acid sequence of SEQ ID NO:5 and further comprising a second transgene comprising a nucleotide sequence encoding a protein sequence with at least 70% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 75% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 80% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 85% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 90% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 91% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 92% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 93% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 94% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 95% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 96% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 97% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 98% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 99% identity to SEQ ID NO:7. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 100% identity to SEQ ID NO:7.

In an aspect, the present disclosure provides tobacco plants comprising at least one mutation in a Nic1b or Nic2 locus (e.g., one or more Nic1b_ERF or Nic2_ERF genes) and a transgene comprising a nucleotide sequence encoding a protein with an amino acid sequence of SEQ ID NO:5 and further comprising a second transgene comprising a nucleotide sequence encoding a protein sequence with at least 70% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 75% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 80% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 85% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 90% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 91% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 92% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 93% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 94% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 95% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 96% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 97% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 98% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 99% identity to SEQ ID NO:8. In a further aspect, the tobacco plant comprises a transgene comprising a nucleotide sequence encoding a protein with an amino acid sequence of SEQ ID NO:5 and further comprises a second transgene comprising a nucleotide sequence encoding a protein sequence with at least 100% identity to SEQ ID NO:8.

In an aspect, a low-nicotine and/or low-TSNA tobacco plant (e.g., with overexpression or elevated levels of CYP82E4v2 and Myb3 (or AtPAP1)) further comprises one of more genetic modifications providing a reduced level of anatabine. Exemplary genetic modifications that provide reduce anatabine can be found in US20160010103A1 and U.S. Ser. No. 10/375,910B2. In an aspect, a anatabine-reducing genetic modification comprising a mutation in a Quinolinate Synthase (QS) gene. In another aspect, a QS gene mutation comprising a mutation resulting in an amino acid substitution at a position corresponding to the cysteine residue at position 487 and/or the valine residue at position 516 of SEQ ID No: 8 of US20160010103A1. In another aspect, a anatabine-reducing genetic modification is present in, introgressed from or originates from tobacco plant line dMS932, wherein a representative sample of seed of said tobacco plant is deposited under ATCC Accession Number PTA-124990. In another aspect, a anatabine-reducing genetic modification is present in, introgressed from or originates from a tobacco plant line selected from the group consisting of MS108, MS445, MS170, and MS3908 from U.S. Ser. No. 10/375,910B2.

In an aspect, the present disclosure further provides tobacco plants, or parts thereof, comprising a nicotine or total alkaloid level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%, where the tobacco plants are capable of producing leaves, when cured, having a USDA grade index value of 50 or more 55 or more, 60 or more, 65 or more, 70 or more, 75 or more, 80 or more, 85 or more, 90 or more, and 95 or more. In another aspect, such a non-transgenic tobacco plant comprises a nicotine level of less than 2.0% and are capable of producing leaves, when cured, having a USDA grade index value of 70 or more. In a further aspect, such a non-transgenic tobacco plant comprises a nicotine level of less than 1.0% and are capable of producing leaves, when cured, having a USDA grade index value of 70 or more.

In an aspect, the present disclosure also provides a tobacco plant, or part thereof, comprising a non-transgenic mutation, where the non-transgenic mutation reduces the nicotine or total alkaloid level of the tobacco plant to below 1%, below 2%, below 5%, below 8%, below 10%, below 12%, below 15%, below 20%, below 25%, below 30%, below 40%, below 50%, below 60%, below 70%, or below 80% of the nicotine level of a control plant when grown in similar growth conditions, where the tobacco plant is capable of producing leaves, when cured, having a USDA grade index value comparable to the USDA grade index value of the control plant, and where the control plant shares an essentially identical genetic background with the tobacco plant except a mutation or modification of interest non-transgenic mutation.

In an aspect, a reduced or increased level is within about 10%, within about 20%, within about 30%, within about 40%, within about 50%, within about 60%, within about 70%, within about 80%, within about 90%, within about 92%, within about 94%, within about 95%, within about 96%, within about 97%, within about 98%, or within about 99% lower or higher than the level in a control tobacco plant or cured leaf from a control tobacco plant when grown and cured under comparable conditions.

In another aspect, a reduced or increased level is within about 1 fold, within about 2 folds, within about 3 folds, within about 4 folds, within about 5 folds, within about 6 folds, within about 7 folds, within about 8 folds, within about 9 folds, within about 10 folds, within about 15 folds, within about 20 folds, within about 25 folds, or within about 30 folds lower or higher than the level in a control tobacco plant or cured leaf from a control tobacco plant when grown and cured under comparable conditions.

In an aspect, a reduced or increased level is at least about 10%, at least about 20%, at least about 30%, at least about 40%, at least about 50%, at least about 60%, at least about 70%, at least about 80%, at least about 90%, at least about 92%, at least about 94%, at least about 95%, at least about 96%, at least about 97%, at least about 98%, or at least about 99% lower or higher than the level in a control tobacco plant or cured leaf from a control tobacco plant when grown and cured under comparable conditions.

In another aspect, a reduced or increased level is at least about 1 fold, at least about 2 folds, at least about 3 folds, at least about 4 folds, at least about 5 folds, at least about 6 folds, at least about 7 folds, at least about 8 folds, at least about 9 folds, at least about 10 folds, at least about 15 folds, at least about 20 folds, at least about 25 folds, or at least about 30 folds lower or higher than the level in a control tobacco plant or cured leaf from a control tobacco plant when grown and cured under comparable conditions.

In an aspect, a reduced or increased level is about 10%, about 20%, about 30%, about 40%, about 50%, about 60%, about 70%, about 80%, about 90%, about 92%, about 94%, about 95%, about 96%, about 97%, about 98%, or about 99% lower or higher than the level in a control tobacco plant or cured leaf from a control tobacco plant when grown and cured under comparable conditions.

In another aspect, a reduced or increased level is about 1 fold, about 2 folds, about 3 folds, about 4 folds, about 5 folds, about 6 folds, about 7 folds, about 8 folds, about 9 folds, about 10 folds, about 15 folds, about 20 folds, about 25 folds, or about 30 folds lower or higher than the level in a control tobacco plant or cured leaf from a control tobacco plant when grown and cured under comparable conditions.

In an aspect, a reduced or increased level is about 1-2 folds, about 2-3 folds, about 3-4 folds, about 4-5 folds, about 5-6 folds, about 6-7 folds, about 7-8 folds, about 8-9 folds, about 9-10 folds, about 10-15 folds, about 15-20 folds, about 20-25 folds, about 25-30 folds, or about 30-50 folds lower or higher than the level in a control tobacco plant or cured leaf from a control tobacco plant when grown and cured under comparable conditions.

In another aspect, a reduced or increased level is about 1-10 folds, about 2-10 folds, about 3-10 folds, about 4-10 folds, about 5-10 folds, about 6-10 folds, about 7-10 folds, about 8-10 folds, about 9-10 folds, about 10-50 folds, about 15-50 folds, about 20-50 folds, about 25-50 folds, or about 30-50 folds lower or higher than the level in a control tobacco plant or cured leaf from a control tobacco plant when grown and cured under comparable conditions.

In an aspect, cured leaf from a modified tobacco plant produces or comprises less than 2, less than 1.8, less than 1.5, less than 1.2, less than 1.0, less than 0.8, less than 0.6, less than 0.4, less than 0.3, less than 0.2, less than 0.15, less than 0.1, or less than 0.05 ppm total TSNAs. In an aspect, cured leaf from a modified tobacco plant comprises between 2 and 0.05, between 1.8 and 0.05, between 1.5 and 0.05, between 1.2 and 0.05, between 1.0 and 0.05, between 0.8 and 0.05, between 0.6 and 0.05, between 0.4 and 0.05, between 0.3 and 0.05, between 0.2 and 0.05, between 0.15 and 0.05, or between 0.1 and 0.05 ppm total TSNAs. In an aspect, cured leaf from a modified tobacco plant comprises between 2 and 0.05, between 1.8 and 0.1, between 1.5 and 0.15, between 1.2 and 0.2, between 1.0 and 0.3, between 0.8 and 0.4, or between 0.6 and 0.5 ppm total TSNAs.

In an aspect, a lower nicotine level refers to an average nicotine level of below 1%, below 2%, below 5%, below 8%, below 10%, below 12%, below 15%, below 20%, below 25%, below 30%, below 40%, below 50%, below 60%, below 70%, or below 80% of the average nicotine level of a control tobacco plant. In another aspect, a lower nicotine level refers to an average nicotine level of about between 0.5% and 1%, between 1% and 2%, between 2% and 3%, between 3% and 4%, between 4% and 5%, between 5% and 6%, between 6% and 7%, between 7% and 8%, between 8% and 9%, between 9% and 10%, between 11% and 12%, between 12% and 13%, between 13% and 14%, between 14% and 15%, between 15% and 16%, between 16% and 17%, between 17% and 18%, between 18% and 19%, between 19% and 20%, between 21% and 22%, between 22% and 23%, between 23% and 24%, between 24% and 25%, between 25% and 26%, between 26% and 27%, between 27% and 28%, between 28% and 29%, or between 29% and 30% of the average nicotine level of a control tobacco plant. In a further aspect, a lower nicotine level refers to an average nicotine level of about between 0.5% and 5%, between 5% and 10%, between 10% and 20%, between 20% and 30% of the average nicotine level of a control tobacco plant.

In an aspect, a tobacco plant provided herein comprises an average nicotine or total alkaloid level selected from the group consisting of about 0.01%, 0.02%, 0.05%, 0.75%, 0.1%, 0.15%, 0.2%, 0.3%, 0.35%, 0.4%, 0.5%, 0.6%, 0.7%, 0.8%, 0.9%, 1%, 1.1%, 1.2%, 1.3%, 1.4%, 1.5%, 1.6%, 1.7%, 1.8%, 1.9%, 2%, 2.1%, 2.2%, 2.3%, 2.4%, 2.5%, 2.6%, 2.7%, 2.8%, 2.9%, 3%, 3.1%, 3.2%, 3.3%, 3.4%, 3.5%, 3.6%, 3.7%, 3.8%, 3.9%, 4%, 5%, 6%, 7%, 8%, and 9% on a dry weight basis. In another aspect, a tobacco plant provided herein comprises an average nicotine or total alkaloid level selected from the group consisting of about between 0.01% and 0.02%, between 0.02% and 0.05%, between 0.05% and 0.75%, between 0.75% and 0.1%, between 0.1% and 0.15%, between 0.15% and 0.2%, between 0.2% and 0.3%, between 0.3% and 0.35%, between 0.35% and 0.4%, between 0.4% and 0.5%, between 0.5% and 0.6%, between 0.6% and 0.7%, between 0.7% and 0.8%, between 0.8% and 0.9%, between 0.9% and 1%, between 1% and 1.1%, between 1.1% and 1.2%, between 1.2% and 1.3%, between 1.3% and 1.4%, between 1.4% and 1.5%, between 1.5% and 1.6%, between 1.6% and 1.7%, between 1.7% and 1.8%, between 1.8% and 1.9%, between 1.9% and 2%, between 2% and 2.1%, between 2.1% and 2.2%, between 2.2% and 2.3%, between 2.3% and 2.4%, between 2.4% and 2.5%, between 2.5% and 2.6%, between 2.6% and 2.7%, between 2.7% and 2.8%, between 2.8% and 2.9%, between 2.9% and 3%, between 3% and 3.1%, between 3.1% and 3.2%, between 3.2% and 3.3%, between 3.3% and 3.4%, between 3.4% and 3.5%, and between 3.5% and 3.6% on a dry weight basis. In a further aspect, a tobacco plant provided herein comprises an average nicotine or total alkaloid level selected from the group consisting of about between 0.01% and 0.1%, between 0.02% and 0.2%, between 0.03% and 0.3%, between 0.04% and 0.4%, between 0.05% and 0.5%, between 0.75% and 1%, between 0.1% and 1.5%, between 0.15% and 2%, between 0.2% and 3%, and between 0.3% and 3.5% on a dry weight basis.

LA Burley 21 (also referenced as LA BU21) is a low total alkaloid tobacco line produced by incorporation of a low alkaloid gene(s) from a Cuban cigar variety into Burley 21 through several backcrosses (Legg et al. 1970). It has approximately 0.2% total alkaloids (dry weight) compared to the about 3.5% (dry weight) of its parent, Burley 21. LA BU21 has a leaf grade well below commercially acceptable standards. LA BU21 also exhibits other unfavorable leaf phenotypes characterized by lower yields, delayed ripening and senescence, higher susceptibility to insect herbivory, and poor end-product quality after curing (Chaplin and Weeks, *Crop Sci.* 16: 416-418 (1976); Legg et al. *Crop. Sci.* 10: 212 (1970); Chaplin and Burk, *Crop Sci.* 75: 133-136 (1983)). LA BU21 leaves further exhibit traits such as higher polyamine content, higher chlorophyll content, and more mesophyll cells per unit leaf area.

The LA Burley 21 line comprises nic1 and nic2 lesions and comprises an average nicotine amount of ~0.3% on a dry weight basis (Range ~0.2-0.6%). Low Intermediate (LI) Burley 21 comprises a nic1 lesion and a wildtype Nic2 locus and comprises an average nicotine amount of ~2.3% (Range ~1.5-3.0%). High Intermediate (HI) Burley 21 comprises a wildtype Nic1 locus and a nic2 lesion and an average nicotine amount of ~3.7% (Range ~2.5-5.0%). Wild-type Burley 21 (also referred to as "BU21") (Nic1 Nic2) comprises an average nicotine amount of ~4.7% (Range ~4.0-6.0%)). See U.S. Patent Application publication US2016/0374387 incorporated herein by reference in its entirety. The Nic 2 locus was previously reported by Shoji et. al (2010) to comprise a deletion of 7 Ethylene Response Factor (ERF) genes. These deleted ERF genes were mapped to a single contiguous region of the TN90 genome.

In an aspect, a modified tobacco plant comprises one or more mutations or modifications capable of providing the reduced level of one or more TSNAs. In another aspect, one or more mutations are further capable of providing one or more traits selected from the group consisting of: i. an increased level of oxygen radicle absorbance capacity (ORAC), and ii. an increased level of one or more antioxidants; wherein the reduced or increased level is compared to a control tobacco plant or cured leaf from a control tobacco plant when grown and cured under comparable. See U.S. Patent Application publication US2018/0119163 incorporated herein by reference in its entirety.

Unless specified otherwise, measurements of alkaloid, polyamine, or nicotine levels (or another leaf chemistry or property characterization) or leaf grade index values mentioned herein for a tobacco plant, variety, cultivar, or line refer to average measurements, including, for example, an average of multiple leaves of a single plant or an average measurement from a population of tobacco plants from a single variety, cultivar, or line. Unless specified otherwise, the nicotine, alkaloid, or polyamine level (or another leaf chemistry or property characterization) of a tobacco plant described here is measured 2 weeks after topping in a pooled leaf sample collected from leaf number 3, 4, and 5 after topping. In another aspect, the nicotine, alkaloid, or polyamine level (or another leaf chemistry or property characterization) of a tobacco plant is measured after topping in a leaf having the highest level of nicotine, alkaloid, or polyamine (or another leaf chemistry or property characterization). In an aspect, the nicotine, alkaloid, or polyamine level of a tobacco plant is measured after topping in leaf number 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30. In another aspect, the nicotine, alkaloid, or polyamine level (or another leaf chemistry or property characterization) of a tobacco plant is measured after topping in a pool of two or more leaves with consecutive leaf numbers selected from the group consisting of leaf number 1, 2, 3, 4, 5, 6, 7, 8, 9, 10, 11, 12, 13, 14, 15, 16, 17, 18, 19, 20, 21, 22, 23, 24, 25, 26, 27, 28, 29, and 30. In another aspect, the nicotine, alkaloid, or polyamine level (or another leaf chemistry or property characterization) of a tobacco plant is measured after topping in a leaf with a leaf number selected from the group consisting of between 1 and 5, between 6 and 10, between 11 and 15, between 16 and 20, between 21 and 25, and between 26 and 30. In another aspect, the nicotine, alkaloid, or polyamine level (or another leaf chemistry or property characterization) of a tobacco plant is measured after topping in a pool of two or more leaves with leaf numbers selected from the group consisting of between 1 and 5, between 6 and 10, between 11 and 15, between 16 and 20, between 21 and 25, and between 26 and 30. In another aspect, the nicotine, alkaloid, or polyamine level (or another leaf chemistry or property characterization) of a tobacco plant is measured after topping in a pool of three or more leaves with leaf numbers selected from the group consisting of between 1 and 5, between 6 and 10, between 11 and 15, between 16 and 20, between 21 and 25, and between 26 and 30.

As used herein, leaf numbering is based on the leaf position on a tobacco stalk with leaf number 1 being the youngest leaf (at the top) after topping and the highest leaf number assigned to the oldest leaf (at the bottom).

A population of tobacco plants or a collection of tobacco leaves for determining an average measurement (e.g., alkaloid or nicotine level or leaf grading) can be of any size, for example, 5, 10, 15, 20, 25, 30, 35, 40, or 50. Industry-accepted standard protocols are followed for determining average measurements or grad index values.

As used herein, "topping" refers to the removal of the stalk apex, including the SAM, flowers, and up to several adjacent leaves, when a tobacco plant is near vegetative maturity and around the start of reproductive growth. Typically, tobacco plants are topped in the button stage (soon after the flower begins to appear). For example, greenhouse or field-grown tobacco plants can be topped when 50% of the plants have at least one open flower. Topping a tobacco plant results in the loss of apical dominance and also induce increased alkaloid production.

Typically, the nicotine, alkaloid, or polyamine level (or another leaf chemistry or property characterization) of a tobacco plant is measured about 2 weeks after topping. Other time points can also be used. In an aspect, the nicotine, alkaloid, or polyamine level (or another leaf chemistry or property characterization) of a tobacco plant is measured about 1, 2, 3, 4, or 5 weeks after topping. In another aspect, the nicotine, alkaloid, or polyamine level (or another leaf chemistry or property characterization) of a tobacco plant is measured about 3, 5, 7, 10, 12, 14, 17, 19, or 21 days after topping.

Unless specified otherwise, the nicotine or alkaloid level (or another leaf chemistry or property characterization) of a tobacco plant is measured after topping in a pooled leaf sample collected from leaf number 3, 4, and 5 after topping. As used herein, whenever a comparison between leaves from two plants (e.g., a mutant plant versus a control plant) is mentioned, leaves from the same or comparable stalk position(s) and developmental stage(s) are intended so that the comparison can demonstrate effects due to genotype differences, not from other factors.

As used herein, "similar growth conditions" or "comparable growth conditions" "or "comparable conditions" refer to similar environmental conditions and/or agronomic practices for growing and making meaningful comparisons between two or more plant genotypes so that neither environmental conditions nor agronomic practices would contribute to or explain any difference observed between the two or more plant genotypes. Environmental conditions include, for example, light, temperature, water (humidity), and nutrition (e.g., nitrogen and phosphorus). Agronomic practices include, for example, seeding, clipping, undercutting, transplanting, topping, and suckering. See Chapters 4B and 4C of Tobacco, Production, Chemistry and Technology, Davis & Nielsen, eds., Blackwell Publishing, Oxford (1999), pp 70-103.

"Alkaloids" are complex, nitrogen-containing compounds that naturally occur in plants, and have pharmacological effects in humans and animals. "Nicotine" is the primary natural alkaloid in commercialized cigarette tobacco and accounts for about 90 percent of the alkaloid content in *Nicotiana tabacum*. Other major alkaloids in tobacco include cotinine, nornicotine, myosmine, nicotyrine, anabasine and anatabine. Minor tobacco alkaloids include nicotine-n-oxide, N-methyl anatabine, N-methyl anabasine, pseudooxynicotine, 2,3 dipyridyl and others.

Alkaloid levels can be assayed by methods known in the art, for example by quantification based on gas-liquid chromatography, high performance liquid chromatography, radio-immunoassays, and enzyme-linked immunosorbent assays. For example, nicotinic alkaloid levels can be measured by a GC-FID method based on CORESTA Recommended Method No. 7, 1987 and ISO Standards (ISO TC 126N 394 E. See also Hibi et al., *Plant Physiology* 100: 826-35 (1992) for a method using gas-liquid chromatography equipped with a capillary column and an FID detector. Unless specified otherwise, all alkaloid levels described here are measured using a method in accordance with CORESTA Method No 62*, Determination of Nicotine in Tobacco and Tobacco Products by Gas Chromatographic Analysis*, February 2005, and those defined in the Centers for Disease Control and Prevention's *Protocol for Analysis of Nicotine, Total Moisture and pH in Smokeless Tobacco Products*, as published in the Federal Register Vol. 64, No. 55 Mar. 23, 1999 (and as amended in Vol. 74, No. 4, Jan. 7, 2009).

Alternatively, tobacco total alkaloids can be measured using a segmented-flow colorimetric method developed for analysis of tobacco samples as adapted by Skalar Instrument Co (West Chester, PA) and described by Collins et al., *Tobacco Science* 13:79-81 (1969). In short, samples of tobacco are dried, ground, and extracted prior to analysis of total alkaloids and reducing sugars. The method then employs an acetic acid/methanol/water extraction and charcoal for decolorization. Determination of total alkaloids was based on the reaction of cyanogen chloride with nicotine alkaloids in the presence of an aromatic amine to form a colored complex which is measured at 460 nm. Unless specified otherwise, total alkaloid levels or nicotine levels shown herein are on a dry weight basis (e.g., percent total alkaloid or percent nicotine).

As used herein, a "reduced" or "increased" level refers to a statistically significant change (reduction or increase) from a reference point. As used herein, "statistically significant" refers to a p-value of less than 0.05, a p-value of less than 0.025, a p-value of less than 0.01, or a p-value of less than 0.001 when using an appropriate measure of statistical significance (e.g., a one-tailed two sample t-test).

As used herein, a "control plant" refers to a comparator plant that is an unmodified tobacco plant of the same variety or a tobacco plant having no transgene of interest, depending on the context or the purpose of the control plant. Control tobacco plants and plants of interest are grown and cured under comparable conditions.

The present disclosure also provides tobacco plants having altered nicotine levels without negative impacts over other tobacco traits, e.g., leaf grade index value. In an aspect, a low-nicotine or nicotine-free tobacco variety provides cured tobacco of commercially acceptable grade. Tobacco grades are evaluated based on factors including, but not limited to, the leaf stalk position, leaf size, leaf color, leaf uniformity and integrity, ripeness, texture, elasticity, sheen (related with the intensity and the depth of coloration of the leaf as well as the shine), hygroscopicity (the faculty of the tobacco leaves to absorb and to retain the ambient moisture), and green nuance or cast. Leaf grade can be determined, for example, using an Official Standard Grade published by the Agricultural Marketing Service of the US Department of Agriculture (7 U.S.C. § 511). See, e.g., Official Standard Grades for Burley Tobacco (U.S. Type 31 and Foreign Type 93), effective Nov. 5, 1990 (55 F.R. 40645); Official Standard Grades for Flue-Cured Tobacco (U.S. Types 11, 12, 13, 14 and Foreign Type 92), effective Mar. 27, 1989 (54 F.R. 7925); Official Standard Grades for Pennsylvania Seedleaf Tobacco (U.S. Type 41), effective Jan. 8, 1965 (29 F.R. 16854); Official Standard Grades for Ohio Cigar-Leaf Tobacco (U.S. Types 42, 43, and 44), effective Dec. 8, 1963 (28 F.R. 11719 and 28 F.R. 11926); Official Standard Grades for Wisconsin Cigar-Binder Tobacco (U.S. Types 54 and 55), effective Nov. 20, 1969 (34 F.R. 17061); Official Standard Grades for Wisconsin Cigar-Binder Tobacco (U.S. Types 54 and 55), effective Nov. 20, 1969 (34 F.R. 17061); Official Standard Grades for Georgia and Florida Shade-Grown Cigar-Wrapper Tobacco (U.S. Type 62), Effective April 1971. A USDA grade index value can be determined according to an industry accepted grade index. See, e.g., Bowman et al, *Tobacco Science,* 32:39-40(1988); Legacy Tobacco Document Library (Bates Document #523267826-523267833, Jul. 1, 1988, Memorandum on the Proposed Burley Tobacco Grade Index); and Miller et al., 1990*, Tobacco Intern.,* 192:55-57 (all foregoing references are incorporated by inference in their entirety). Unless specified otherwise, a USDA grade index is a 0-100 numerical representation of federal grade received and is a weighted average of all stalk positions. A higher grade index indicates higher quality. Alternatively, leaf grade can be determined via hyper-spectral imaging. See e.g., WO 2011/027315 (published on Mar. 10, 2011, and incorporated by inference in its entirety).

In an aspect, a modified tobacco plant provided herein comprises tobacco leaf with reduced total TSNAs and further comprises one or more desirable or enhanced properties, e.g., inhibited or reduced sucker growth prior to or after topping. In an aspect, a modified plant provided herein comprises fewer total suckers, smaller suckers, or both compared to a control plant lacking such modification when grown and cured under comparable conditions. In an aspect, smaller suckers of a modified plant provided herein comprise reduced mass, reduced length, reduced diameter, or a combination thereof compared to suckers of a control plant grown and cured under comparable conditions.

In an aspect, a tobacco plant provided herein comprises a similar level of one or more tobacco aroma compounds selected from the group consisting of 3-methylvaleric acid, valeric acid, isovaleric acid, a labdenoid, a cembrenoid, a sugar ester, and a reducing sugar, compared to a control tobacco plant when grown in similar growth conditions. In another aspect, a tobacco plant provided herein comprises a nic1 mutation, a nic2 mutation, or a combination thereof having no impact over the level of one or more tobacco aroma compounds selected from the group consisting of 3-methylvaleric acid, valeric acid, isovaleric acid, a labdenoid, a cembrenoid, a sugar ester, and a reducing sugar.

As used herein, tobacco aroma compounds are compounds associated with the flavor and aroma of tobacco smoke. These compounds include, but are not limited to, 3-methylvaleric acid, valeric acid, isovaleric acid, cembrenoid and labdenoid diterpenes, and sugar esters. Concentrations of tobacco aroma compounds can be measured by any known metabolite profiling methods in the art including, without limitation, gas chromatography mass spectrometry (GC-MS), Nuclear Magnetic Resonance Spectroscopy, liquid chromatography-linked mass spectrometry. See The Handbook of Plant Metabolomics, edited by Weckwerth and Kahl, (Wiley-Blackwell) (May 28, 2013).

As used herein, "reducing sugar(s)" are any sugar (monosaccharide or polysaccharide) that has a free or potentially free aldehyde or ketone group. Glucose and fructose act as nicotine buffers in cigarette smoke by reducing smoke pH and effectively reducing the amount of "free" unprotonated nicotine. Reducing sugars balances smoke flavor, for example, by modifying the sensory impact of nicotine and other tobacco alkaloids. An inverse relationship between sugar content and alkaloid content has been reported across tobacco varieties, within the same variety, and within the same plant line caused by planting conditions. Reducing sugar levels can be measured using a segmented-flow colorimetric method developed for analysis of tobacco samples as adapted by Skalar Instrument Co (West Chester, PA) and described by Davis, *Tobacco Science* 20:139-144 (1976). For example, a sample is dialyzed against a sodium carbonate solution. Copper neocuproin is added to the sample and the solution is heated. The copper neocuproin chelate is reduced in the presence of sugars resulting in a colored complex which is measured at 460 nm.

In an aspect, a tobacco plant provided herein comprises one or more non-naturally existing mutant alleles at a Nic1b or Nic2 locus (e.g., one or more Nic1b_ERF or Nic2_ERF genes) which reduces or eliminates gene activity of one or more genes of the Nic1b or Nic2 locus (e.g., one or more Nic1b_ERF or Nic2_ERF genes). In an aspect, these mutant alleles result in lower nicotine levels. Mutant Nic2 alleles can be introduced by any method known in the art including random or targeted mutagenesis approaches.

As used herein, a mutation refers to an inheritable genetic modification introduced into a gene to reduce, inhibit, or eliminate the expression or activity of a product encoded by the gene. Such a modification can be in any sequence region of a gene, for example, in a promoter, 5' UTR, exon, intron, 3' UTR, or terminator region. In an aspect, mutations are not natural polymorphisms that exist in a particular tobacco variety or cultivar. As used herein, a "mutant allele" refers to an allele from a locus where the allele comprises a mutation.

Mutagenesis methods provided herein include, without limitation, treatment of seeds with ethyl methylsulfate (EMS) (Hildering and Verkerk, In, The use of induced mutations in plant breeding. Pergamon press, pp 317-320, 1965) or UV-irradiation, X-rays, and fast neutron irradiation (see, for example, Verkerk, *Neth. J. Agric. Sci.* 19:197-203, 1971; and Poehlman, Breeding Field Crops, Van Nostrand Reinhold, New York (3.sup.rd ed), 1987), transposon tagging (Fedoroff et al., 1984; U.S. Pat. Nos. 4,732,856 and 5,013,658), as well as T-DNA insertion methodologies (Hoekema et al., 1983; U.S. Pat. No. 5,149,645). EMS-induced mutagenesis consists of chemically inducing random point mutations over the length of the genome. Fast neutron mutagenesis consists of exposing seeds to neutron bombardment which causes large deletions through double stranded DNA breakage. Transposon tagging comprises inserting a transposon within an endogenous gene to reduce or eliminate expression of the gene. The types of mutations that may be present in a tobacco gene include, for example, point mutations, deletions, insertions, duplications, and inversions. Such mutations desirably are present in the coding region of a tobacco gene; however mutations in the promoter region, and intron, or an untranslated region of a tobacco gene may also be desirable.

In addition, a fast and automatable method for screening for chemically induced mutations, TILLING (Targeting Induced Local Lesions In Genomes), using denaturing HPLC or selective endonuclease digestion of selected PCR products is also applicable to the present disclosure. See, McCallum et al. (2000) *Nat. Biotechnol.* 18:455-457. Mutations that impact gene expression or that interfere with the function of genes can be determined using methods that are well known in the art. Insertional mutations in gene exons usually result in null-mutants. Mutations in conserved residues can be particularly effective in inhibiting the function of a protein. In an aspect, a tobacco plant comprises a nonsense (e.g., stop codon) mutation is one or more NCG genes described herein.

Is an aspect, the present disclosure also provides tobacco lines with altered nicotine levels while maintaining commercially acceptable leaf quality. These lines can be produced by introducing mutations into one or more genes of the Nic1b or Nic2 locus (e.g., one or more Nic1b_ERF or Nic2_ERF genes) via precise genome engineering technologies, for example, Transcription activator-like effector nucleases (TALENs), meganuclease, zinc finger nuclease, and a clustered regularly-interspaced short palindromic repeats (CRISPR)/Cas9 system, a CRISPR/CasX system, a CRISPR/CasY system, a CRISPR/Cpf1 system, a CRISPR/Csm1 system, and a combination thereof (see, for example, U.S. Patent Application publication 2017/0233756). See, e.g., Gaj et al., *Trends in Biotechnology,* 31(7):397-405 (2013).

The screening and selection of mutagenized tobacco plants can be through any methodologies known to those having ordinary skill in the art. Examples of screening and selection methodologies include, but are not limited to, Southern analysis, PCR amplification for detection of a polynucleotide, Northern blots, RNase protection, primer-extension, RT-PCR amplification for detecting RNA transcripts, Sanger sequencing, Next Generation sequencing technologies (e.g., Illumina, PacBio, Ion Torrent, 454), enzymatic assays for detecting enzyme or ribozyme activity of polypeptides and polynucleotides, and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

In an aspect, a modified tobacco plant comprises one or more mutations or modifications capable of activating one or more genes encoding a biosynthetic enzyme, a regulatory transcription factor, a transporter, a catabolic enzyme, or a combination thereof, for one or more antioxidants. In another aspect, one or more mutations or modifications are in one or more genes encoding a biosynthetic enzyme, a regulatory transcription factor, a transporter, a catabolic enzyme, or a combination thereof, for one or more antioxidants selected from the group consisting of anthocyanidin, flavanone, flavanol, flavone, flavonol, isoflavone, hydroxybenzoic acid, hydroxycinnamic acid, ellagitannin, stibene, lignan, carotenoids, and glycyrrhzin. In a further aspect, one or more mutations or modifications are in one or more genes encoding a biosynthetic enzyme, a regulatory transcription factor, a transporter, a catabolic enzyme, or a combination thereof, for one or more antioxidants selected from the group consisting of Delphinidin, Cyanidin, Procyanidin, Prodelphinidin, Hesperetin, Naringenin, Catechin, Epicatechin, Apigenin, Luteonin, Quercetin, Myricetin, Rutin, Genistein, Daidzein, Gallic acid, Vanillic acid, Protocatechuic acid, Ferunic acid, Cinnamic acid, Coumeric acid, Chlorogenic acid, Coffeic acid, ferulic acid, Sanguiin, Resveratrol, Sesamin, Caretonoids, and Vitamin C.

In an aspect, a modified tobacco plant of the present specification comprises tobacco leaves with increased levels of anthocyanins. In a further aspect, a modified tobacco plant with increased levels of anthocyanins further comprises leaves that have a purple or crimson visual appearance. In an aspect, a modified tobacco plant of the present specification comprises tobacco leaves with increased levels of antioxidants and without increased levels of anthocyanins. In a further aspect, a modified tobacco plant comprising increased levels of antioxidants and without increased levels of anthocyanins further comprises leaves with a visual appearance similar to an unmodified tobacco plant.

As used herein, an "antioxidant regulatory protein" refers to a biosynthetic enzyme, regulatory transcription factor, or transport protein that when mutated or expressed in a tobacco plant can change the amounts of one or more antioxidants compared to a control plant that does not comprise the mutated or expressed biosynthetic enzyme, regulatory transcription factor, or transport protein.

As used herein, a "biosynthetic enzyme" refers to a protein that functions in the synthesis of antioxidants, alkaloids, TSNAs, Chlorogenic Acid or other proteins affecting the activity or stability of antioxidants, alkaloids, TSNAs, or Chlorogenic Acid. These proteins catalyze reactions that result in the transformation of one molecular structure into another structure as part of a biosynthesis pathway. Exemplary biosynthetic enzymes include but are limited to Anthocyanidin synthase2 (NtANS2), Dihyfroflavonol-4-reductase (NtDFR2), Shikimate O-hydroxycinnamoyl transferase (HCT) and Hydroxycinnamoyl CoA quinate Transferase (HQT). The activity of a biosynthetic enzyme effects the total concentration of different molecule species that compose a biosynthetic pathway.

As used herein, a "regulatory transcription factor" is a protein that binds a promoter element of a target gene to modulate the transcription of one or more genes involved in antioxidant biosynthesis, transport, catabolism, or other processes affecting the level of one or more antioxidants. Exemplary regulatory transcription factors include AtPAP1, NtPAP1, NtMYB3-like, NtJAF13, and AtTTG1, see U.S. Patent Application Publication US2018/0119163, incorporated herein by reference in its entirety. A regulatory transcription factor can bind DNA as part of a protein complex or individually. A regulatory transcription factor can have a single target or multiple targets and can bind different targets with varying affinities. The activity of a regulatory transcription factor can be to activate, repress, or attenuate transcription from a target loci.

As used herein, a "transport protein" can be a transmembrane protein that actively or passively moves molecules across a biological membrane. A transport protein can aid in the movement of ions, small molecules or macromolecules. A transport protein can be referred to as a transmembrane transporter, a transmembrane pump, an anion transport protein, a cation transport protein, or an escort protein. Transport proteins can also facilitate the movement of molecules or proteins in vesicles composed of biological membrane. A transport protein can be integrated into a biological membrane. A Transport protein can be anchored to a biological membrane via different modifications such as, but not limited to, myristolation, prenylation, or palmitoylation.

In an aspect, a tobacco plant or plant genome provided herein is mutated or edited by a nuclease selected from the group consisting of a meganuclease, a zinc-finger nuclease (ZFN), a transcription activator-like effector nuclease (TALEN), a CRISPR/Cas9 nuclease, a CRISPR/CasX nuclease, a CRISPR/CasY nuclease, a CRISPR/Cpf1 nuclease, or a CRISPR/Csm1 nuclease.

As used herein, "editing" or "genome editing" refers to targeted mutagenesis of at least 1, at least 2, at least 3, at least 4, at least 5, at least 6, at least 7, at least 8, at least 9, or at least 10 nucleotides of an endogenous plant genome nucleic acid sequence, or removal or replacement of an endogenous plant genome nucleic acid sequence. In an aspect, an edited nucleic acid sequence provided has at least 99.9%, at least 99.5%, at least 99%, at least 98%, at least 97%, at least 96%, at least 95%, at least 94%, at least 93%, at least 92%, at least 91%, at least 90%, at least 85%, at least 80%, or at least 75% sequence identity with an endogenous nucleic acid sequence. In an aspect, an edited nucleic acid sequence provided has at least 99.9%, at least 99.5%, at least 99%, at least 98%, at least 97%, at least 96%, at least 95%, at least 94%, at least 93%, at least 92%, at least 91%, at least 90%, at least 85%, at least 80%, or at least 75% sequence identity with a polynucleotide selected from the group consisting of SEQ ID NOs: 1 to 4, and fragments thereof. In another aspect, an edited nucleic acid sequence provided has at least 99.9%, at least 99.5%, at least 99%, at least 98%, at least 97%, at least 96%, at least 95%, at least 94%, at least 93%, at least 92%, at least 91%, at least 90%, at least 85%, at least 80%, or at least 75% sequence identity with a polynucleotide encoding a polypeptide selected from the group consisting of SEQ ID NOs:5 to 8.

In an aspect, sequence identity can be altered through any means known in the art capable of substitutions, additions, or deletions of a nucleotide or amino acid of one sequence relative to a reference sequence.

Meganucleases, ZFNs, TALENs, CRISPR/Cas9, CRISPR/CasX, CRISPR/CasY, CRISPR/Csm1 and CRISPR/Cpf1 induce a double-strand DNA break at a target site of a genomic sequence that is then repaired by the natural processes of homologous recombination (HR) or non-homologous end-joining (NHEJ). Sequence modifications then occur at the cleaved sites, which can include deletions or insertions that result in gene disruption in the case of NHEJ, or integration of donor nucleic acid sequences by HR. In an aspect, a method provided comprises editing a plant genome with a nuclease provided to mutate at least 1, at least 2, at least 3, at least 4, at least 5, at least 6, at least 7, at least 8, at least 9, at least 10, or more than 10 nucleotides in the plant genome via HR with a donor polynucleotide. In an aspect, a mutation provided is caused by genome editing using a nuclease. In another aspect, a mutation provided is caused by non-homologous end-joining or homologous recombination.

In an aspect, a mutation provided here provides a dominant mutant that activates the expression or activity of a gene of interest, e.g., a gene selected from the group consisting of a biosynthetic enzyme, a regulatory transcription factor, a transporter, a catabolic enzyme, or a combination thereof, for one or more antioxidants.

Meganucleases, which are commonly identified in microbes, are unique enzymes with high activity and long recognition sequences (>14 bp) resulting in site-specific digestion of target DNA. Engineered versions of naturally occurring meganucleases typically have extended DNA recognition sequences (for example, 14 to 40 bp). The engineering of meganucleases can be more challenging than that of ZFNs and TALENs because the DNA recognition and cleavage functions of meganucleases are intertwined in a single domain. Specialized methods of mutagenesis and high-throughput screening have been used to create novel meganuclease variants that recognize unique sequences and possess improved nuclease activity.

ZFNs are synthetic proteins consisting of an engineered zinc finger DNA-binding domain fused to the cleavage domain of the FokI restriction endonuclease. ZFNs can be designed to cleave almost any long stretch of double-stranded DNA for modification of the zinc finger DNA-binding domain. ZFNs form dimers from monomers composed of a non-specific DNA cleavage domain of FokI endonuclease fused to a zinc finger array engineered to bind a target DNA sequence.

The DNA-binding domain of a ZFN is typically composed of 3-4 zinc-finger arrays. The amino acids at positions −1, +2, +3, and +6 relative to the start of the zinc finger ∞-helix, which contribute to site-specific binding to the target DNA, can be changed and customized to fit specific target sequences. The other amino acids form the consensus backbone to generate ZFNs with different sequence specificities. Rules for selecting target sequences for ZFNs are known in the art.

The FokI nuclease domain requires dimerization to cleave DNA and therefore two ZFNs with their C-terminal regions are needed to bind opposite DNA strands of the cleavage site (separated by 5-7 bp). The ZFN monomer can cute the target site if the two-ZF-binding sites are palindromic. The term ZFN, as used herein, is broad and includes a monomeric ZFN that can cleave double stranded DNA without assistance from another ZFN. The term ZFN is also used to refer to one or both members of a pair of ZFNs that are engineered to work together to cleave DNA at the same site.

Without being limited by any scientific theory, because the DNA-binding specificities of zinc finger domains can in principle be re-engineered using one of various methods, customized ZFNs can theoretically be constructed to target nearly any gene sequence. Publicly available methods for engineering zinc finger domains include Context-dependent Assembly (CoDA), Oligomerized Pool Engineering (OPEN), and Modular Assembly.

TALENs are artificial restriction enzymes generated by fusing the transcription activator-like effector (TALE) DNA binding domain to a FokI nuclease domain. When each member of a TALEN pair binds to the DNA sites flanking a target site, the FokI monomers dimerize and cause a double-stranded DNA break at the target site. The term TALEN, as used herein, is broad and includes a monomeric TALEN that can cleave double stranded DNA without assistance from another TALEN. The term TALEN is also used to refer to one or both members of a pair of TALENs that work together to cleave DNA at the same site.

Transcription activator-like effectors (TALEs) can be engineered to bind practically any DNA sequence. TALE proteins are DNA-binding domains derived from various plant bacterial pathogens of the genus *Xanthomonas*. The *Xanthomonas* pathogens secrete TALEs into the host plant cell during infection. The TALE moves to the nucleus, where it recognizes and binds to a specific DNA sequence in the promoter region of a specific DNA sequence in the promoter region of a specific gene in the host genome. TALE has a central DNA-binding domain composed of 13-28 repeat monomers of 33-34 amino acids. The amino acids of each monomer are highly conserved, except for hypervariable amino acid residues at positions 12 and 13. The two variable amino acids are called repeat-variable diresidues (RVDs). The amino acid pairs NI, NG, HD, and NN of RVDs preferentially recognize adenine, thymine, cytosine, and guanine/adenine, respectively, and modulation of RVDs can recognize consecutive DNA bases. This simple relationship between amino acid sequence and DNA recognition has allowed for the engineering of specific DNA binding domains by selecting a combination of repeat segments containing the appropriate RVDs.

Besides the wild-type FokI cleavage domain, variants of the FokI cleavage domain with mutations have been designed to improve cleavage specificity and cleavage activity. The FokI domain functions as a dimer, requiring two constructs with unique DNA binding domains for sites in the target genome with proper orientation and spacing. Both the number of amino acid residues between the TALEN DNA binding domain and the FokI cleavage domain and the number of bases between the two individual TALEN binding sites are parameters for achieving high levels of activity.

A relationship between amino acid sequence and DNA recognition of the TALE binding domain allows for designable proteins. Software programs such as DNA Works can be used to design TALE constructs. Other methods of designing TALE constructs are known to those of skill in the art. See Doyle et al. *Nucleic Acids Research* (2012) 40: W117-122; Cermak et al., *Nucleic Acids Research* (2011). 39:e82; and tale-nt.cac.cornell.edu/about.

A CRISPR/Cas9, CRISPR/CasX, CRISPR/CasY, CRISPR/Csm1, or a CRISPR/Cpf1 system are alternatives to the FokI-based methods ZFN and TALEN. The CRISPR systems are based on RNA-guided engineered nucleases that use complementary base pairing to recognize DNA sequences at target sites.

CRISPR/Cas9, CRISPR/Csm1, and a CRISPR/Cpf1 systems are part of the adaptive immune system of bacteria and archaea, protecting them against invading nucleic acids such as viruses by cleaving the foreign DNA in a sequence-dependent manner. The immunity is acquired by the integration of short fragments of the invading DNA known as spacers between two adjacent repeats at the proximal end of a CRISPR locus. The CRISPR arrays, including the spacers, are transcribed during subsequent encounters with invasive DNA and are processed into small interfering CRISPR RNAs (crRNAs) approximately 40 NT in length, which combine with the trans-activating CRISPR RNA (tracrRNA) to activate and guide the Cas9 nuclease. This cleaves homologous double-stranded DNA sequences known as protospacers in the invading DNA. A prerequisite for cleavage is the presence of a conserved protospacer-adjacent motif (PAM) downstream of the target DNA, which usually has the sequence 5-NGG-3 but less frequently NAG. Specificity is provided by the so-called "seed sequence" approximately 12 bases upstream of the PAM, which must match between the RNA and target DNA. Cpf1 and Csm1 act in a similar manner to Cas9, but Cpf1 and Csm1 do not require a tracrRNA.

In still another aspect, a tobacco plant provided further comprises one or more transgenes encoding a nicotine demethylase (e.g., CYP82E4, CYP82E5, CYP82E10) that confer increased amounts of nornicotine (See U.S. Pat. Nos. 8,319,011; 8,124,851; 9,187,759; 9,228,194; 9,228,195; 9,247,706 for exemplary nicotine demethylase sequences) compared to control plant lacking the one or more transgenes. In an aspect, a modified tobacco plant described further comprises increased nicotine demethylase activity compared to a control plant when grown and cured under comparable conditions.

The term "inhibitory sequence" encompasses any polynucleotide or polypeptide sequence capable of inhibiting the expression or function of a gene involved in nicotine biosynthesis regulation from Nic1b or Nic2 locus (e.g., one or more Nic1b_ERF or Nic2_ERF genes) in a plant, such as full-length polynucleotide or polypeptide sequences, truncated polynucleotide or polypeptide sequences, fragments of polynucleotide or polypeptide sequences, variants of polynucleotide or polypeptide sequences, sense-oriented nucleotide sequences, antisense-oriented nucleotide sequences, the complement of a sense- or antisense-oriented nucleotide sequence, inverted regions of nucleotide sequences, hairpins of nucleotide sequences, double-stranded nucleotide sequences, single-stranded nucleotide sequences, combinations thereof, and the like. The term "polynucleotide sequence" includes sequences of RNA, DNA, chemically modified nucleic acids, nucleic acid analogs, combinations thereof, and the like.

Inhibitory sequences are designated by the name of the target gene product. Thus, a "Nic2 inhibitory sequence" refers to an inhibitory sequence that is capable of inhibiting the expression of a gene involved in nicotine biosynthesis regulation from Nic2 locus in a plant, for example, at the level of transcription and/or translation, or which is capable of inhibiting the function of a gene product. When the phrase "capable of inhibiting" is used in the context of a polynucleotide inhibitory sequence, it is intended to mean that the inhibitory sequence itself exerts the inhibitory effect; or, where the inhibitory sequence encodes an inhibitory nucleotide molecule (for example, hairpin RNA, miRNA, or double-stranded RNA polynucleotides), or encodes an inhibitory polypeptide (e.g., a polypeptide that inhibits expression or function of the target gene product), following its transcription (for example, in the case of an inhibitory sequence encoding a hairpin RNA, miRNA, or double-stranded RNA polynucleotide) or its transcription and translation (in the case of an inhibitory sequence encoding an inhibitory polypeptide), the transcribed or translated product, respectively, exerts the inhibitory effect on the target gene product (e.g., inhibits expression or function of the target gene product).

In an aspect, a genetic modification suppressing one or more Nic1b or Nic2 genes comprises one or more Nic1b or Nic2 inhibitory sequence. A Nic1b or Nic2 inhibitory sequence disclosed can be a sequence triggering gene silencing via any silencing pathway or mechanism known in the art, including, but not limited to, sense suppression/co-suppression, antisense suppression, double-stranded RNA (dsRNA) interference, hairpin RNA interference and intron-containing hairpin RNA interference, amplicon-mediated interference, ribozymes, small interfering RNA, artificial or synthetic microRNA, and artificial trans-acting siRNA. A Nic1b or Nic2 inhibitory sequence may range from at least about 20 nucleotides, about 50 nucleotides, about 70 nucleotides, about 100 nucleotides, about 150 nucleotides, about 200 nucleotides, about 250 nucleotides, about 300 nucleotides, about 350 nucleotides, about 400 nucleotides, and up to the full-length polynucleotide encoding the proteins of the present disclosure, depending upon the desired outcome. In an aspect, a Nic1b or Nic2 inhibitory sequence can be a fragment of between about 50 and about 400 nucleotides, between about 70 and about 350 nucleotides, between about 90 and about 325 nucleotides, between about 90 and about 300 nucleotides, between about 90 and about 275 nucleotides, between about 100 and about 400 nucleotides, between about 100 and about 350 nucleotides, between about 100 and about 325 nucleotides, between about 100 and about 300 nucleotides, between about 125 and about 300 nucleotides, or between about 125 and about 275 nucleotides in length. In some embodiments, a fragment of a cytochrome P450 polynucleotide is about 50, about 60, about 70, about 80, about 90, about 100, about 125, about 150, about 175, about 200, about 225, about 250, about 275, about 300, about 325, about 350, about 400 nucleotides in length, and other such values between about 70 and about 400 nucleotides. In an aspect, a Nic1b or Nic2 inhibitory sequence may comprise about 20, 21, 22, 23, 24, 25, 26, 27, 28, 29, or 30 nucleotides.

The use of the term "polynucleotide" is not intended to limit the present disclosure to polynucleotides comprising DNA. Those of ordinary skill in the art will recognize that polynucleotides can comprise ribonucleotides and combinations of ribonucleotides and deoxyribonucleotides. Such deoxyribonucleotides and ribonucleotides include both naturally occurring molecules and synthetic analogues. The polynucleotides of the present disclosure also encompass all forms of sequences including, but not limited to, single-stranded forms, double-stranded forms, hairpins, stem-and-loop structures, and the like.

In an aspect, the present disclosure provides recombinant DNA constructs comprising a promoter that is functional in a tobacco cell and operably linked to a polynucleotide that encodes an RNA molecule capable of binding to an RNA encoding a polypeptide having an amino acid sequence at least 80%, at least 85%, at least 90%, at least 95%, at least 97%, at least 98%, at least 99% identical to an amino acid sequence selected from the group consisting of SEQ ID NOs: 5 to 8, and fragments thereof, and where the RNA molecule suppresses the expression of the polypeptide. In an aspect, the RNA molecule is selected from the group consisting of a microRNA, an siRNA, and a trans-acting siRNA. In another aspect, the recombinant DNA construct encodes a double stranded RNA. Also provided are transgenic tobacco plants or parts thereof, cured tobacco material, or tobacco products comprising these recombinant DNA constructs. In an aspect, these transgenic plants, cured tobacco material, or tobacco products comprise a lower level of nicotine compared to a control tobacco plant without the recombinant DNA construct. Further provided are methods of reducing the nicotine level of a tobacco plant, the method comprising transforming a tobacco plant with any of these recombinant DNA constructs.

As used herein, "operably linked" refers to a functional linkage between two or more elements. For example, an operable linkage between a polynucleotide of interest and a regulatory sequence (e.g., a promoter) is a functional link that allows for expression of the polynucleotide of interest. Operably linked elements may be contiguous or non-contiguous.

As used herein and when used in reference to a sequence, "heterologous" refers to a sequence that originates from a foreign species, or, if from the same species, is substantially modified from its native form in composition and/or genomic locus by deliberate human intervention. The term also is applicable to nucleic acid constructs, also referred to herein as "polynucleotide constructs" or "nucleotide constructs." In this manner, a "heterologous" nucleic acid construct is intended to mean a construct that originates from a foreign species, or, if from the same species, is substantially modified from its native form in composition and/or genomic locus by deliberate human intervention. Heterologous nucleic acid constructs include, but are not limited to, recombinant nucleotide constructs that have been introduced into a plant or plant part thereof, for example, via transformation methods or subsequent breeding of a transgenic plant with another plant of interest. In an aspect, a promoter used is heterologous to the sequence driven by the promoter. In another aspect, a promoter used is heterologous to tobacco. In a further aspect, a promoter used is native to tobacco.

In an aspect, a modified tobacco plant described is a cisgenic plant. As used herein, "cisgenesis" or "cisgenic" refers to genetic modification of a plant, plant cell, or plant genome in which all components (e.g., promoter, donor nucleic acid, selection gene) have only plant origins (i.e., no non-plant origin components are used). In an aspect, a modified plant, plant cell, or plant genome provided is cisgenic. Cisgenic plants, plant cells, and plant genomes provided can lead to ready-to-use tobacco lines. In another aspect, a modified tobacco plant provided comprises no non-tobacco genetic material or sequences.

As used herein, "gene expression" refers to the biosynthesis or production of a gene product, including the transcription and/or translation of the gene product.

Also provided herein are compositions and methods for overexpressing one or more nicotine demethylase polypeptides in a plant having transgenic or mutagenic suppression of one or more genes from Nic1b or Nic2 locus (e.g., one or more Nic1b_ERF or Nic2_ERF genes) in a plant, particularly plants of the *Nicotiana* genus, including tobacco plants of the various commercial varieties, and further optionally comprising another genetic modification increasing the level of one or more antioxidants.

In an aspect, recombinant DNA constructs or expression cassettes can also comprise a selectable marker gene for the selection of transgenic cells. Selectable marker genes include, but are not limited to, genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional selectable markers include phenotypic markers such as P-galactosidase and fluorescent proteins such as green fluorescent protein (GFP).

In an aspect, recombinant DNA constructs or expression cassettes comprise a promoter selected from the group consisting of a constitutive promoter, an inducible promoter, and a tissue-preferred promoter (for example, a leaf-specific or root-specific promoter). Exemplary constitutive promoters include the core promoter of the Rsyn7 promoter and other constitutive promoters disclosed in U.S. Pat. No. 6,072,050; the core CaMV 35S promoter (Odell et al. (1985) Nature 313:810-812); ubiquitin (Christensen et al. (1989) Plant Mol. Biol. 12:619-632 and Christensen et al. (1992) Plant Mol. Biol. 18:675-689); pEMU (Last et al. (1991) Theor. Appl. Genet. 81:581-588); MAS (Velten et al. (1984) EMBO J 3:2723-2730); ALS promoter (U.S. Pat. No. 5,659, 026), and the like. Exemplary chemical-inducible promoters include the tobacco PR-la promoter, which is activated by salicylic acid. Other chemical-inducible promoters of interest include steroid-responsive promoters (see, for example, the glucocorticoid-inducible promoter in Schena et al. (1991) Proc. Natl. Acad. Sci. USA 88:10421-10425 and McNellis et al. (1998) Plant J. 14(2):247-257) and tetracycline-inducible promoters (see, for example, Gatz et al. (1991) Mol. Gen. Genet. 227:229-237, and U.S. Pat. Nos. 5,814,618 and 5,789,156). Additional exemplary promoters that can be used are those responsible for heat-regulated gene expression, light-regulated gene expression (for example, the pea rbcS-3A; the maize rbcS promoter; the chlorophyll alb-binding protein gene found in pea; or the Arabssu promoter), hormone-regulated gene expression (for example, the abscisic acid (ABA) responsive sequences from the Em gene of wheat; the ABA-inducible HVA1 and HVA22, and rd29A promoters of barley and *Arabidopsis*; and wound-induced gene expression (for example, of wunl), organ specific gene expression (for example, of the tuber-specific storage protein gene; the 23-kDa zein gene from maize described by; or the French bean (ß-phaseolin gene), or pathogen-inducible promoters (for example, the PR-1, prp-1, or (ß-1,3 glucanase promoters, the fungal-inducible wirla promoter of wheat, and the nematode-inducible promoters, TobRB7-5A and Hmg-1, of tobacco arid parsley, respectively).

Various types of promoters can be used in a transgene or recombinant nucleic acid described here (e.g., for expressing a nicotine demethylase, NtMyb3, or AtPAP1), which are classified according to a variety of criteria relating to the pattern of expression of a coding sequence or gene (including a transgene) operably linked to the promoter, such as constitutive, developmental, tissue-specific, tissue-preferred, inducible, etc. Promoters that initiate transcription in all or most tissues of the plant are referred to as "constitutive" promoters. Promoters that initiate transcription during certain periods or stages of development are referred to as "developmental" promoters. Promoters whose expression is enhanced in certain tissues of the plant relative to other plant tissues are referred to as "tissue-enhanced" or "tissue-preferred" promoters. Thus, a "tissue-preferred" promoter causes relatively higher or preferential expression in a specific tissue(s) of the plant, but with lower levels of expression in other tissue(s) of the plant. Promoters that express within a specific tissue(s) of the plant, with little or no expression in other plant tissues, are referred to as "tissue-specific" promoters. A promoter that expresses in a certain cell type of the plant is referred to as a "cell type specific" promoter. An "inducible" promoter is a promoter that initiates transcription in response to an environmental stimulus such as cold, drought, heat or light, or other stimuli, such as wounding or chemical application. Also used here are promoters that are classified in terms of its origin, such as being heterologous, homologous, chimeric, synthetic, etc. A "heterologous" promoter is a promoter sequence having a different origin relative to its associated transcribable sequence, coding sequence, or gene (or transgene), and/or not naturally occurring in the plant species to be transformed. The term "heterologous" more broadly includes a combination of two or more DNA molecules or sequences when such a combination is not normally found in nature. For example, two or more DNA molecules or sequences would be heterologous with respect to each other if they are normally found in different genomes or at different loci in the same genome, or if they are not identically combined in nature.

In an aspect, a tobacco plant provided further comprises increased or reduced expression of activity of genes involved in nicotine biosynthesis or transport. Genes involved in nicotine biosynthesis include, but are not limited to, arginine decarboxylase (ADC), methylputrescine oxidase (MPO), NADH dehydrogenase, ornithine decarboxylase (ODC), phosphoribosylanthranilate isomerase (PRAI), putrescine N-methyltransferase (PMT), quinolate phosphoribosyl transferase (QPT), and S-adenosyl-methionine synthetase (SAMS). Nicotine Synthase, which catalyzes the condensation step between a nicotinic acid derivative and methylpyrrolinium cation, has not been elucidated although two candidate genes (A622 and NBB1) have been proposed. See US 2007/0240728 A1 and US 2008/0120737A1. A622 encodes an isoflavone reductase-like protein. In addition, several transporters may be involved in the translocation of nicotine. A transporter gene, named MATE, has been cloned and characterized (Morita et al., PNAS 106:2447-52 (2009)).

In an aspect, a tobacco plant provided further comprises an increased or reduced level of mRNA, protein, or both of one or more genes encoding a product selected from the group consisting of PMT, MPO, QPT, ADC, ODC, PRAI, SAMS, BBL, MATE, A622, and NBB1, compared to a control tobacco plant. In another aspect, a tobacco plant provided further comprises a transgene directly suppressing the expression of one or more genes encoding a product selected from the group consisting of PMT, MPO, QPT, ADC, ODC, PRAI, SAMS, BBL, MATE, A622, and NBB1. In another aspect, a tobacco plant provided further comprises a transgene or mutation suppressing the expression or activity of one or more genes encoding a product selected from the group consisting of PMT, MPO, QPT, ADC, ODC, PRAI, SAMS, BBL, MATE, A622, and NBB1. In another aspect, a tobacco plant provided further comprises a transgene expressing one or more genes encoding a product selected from the group consisting of PMT, MPO, QPT, ADC, ODC, PRAI, SAMS, BBL, MATE, A622, and NBB1.

Enhancer elements are regions of DNA that can be bound by proteins to activate RNA transcription. In an aspect, a promoter sequence used herein is operably linked to an enhancer element. In an aspect, an enhancer element provided herein is a CsVMV promoter.

Also disclosed are the transformation of tobacco plants with recombinant constructs or expression cassettes described using any suitable transformation methods known in the art. Methods for introducing polynucleotide sequences into tobacco plants are known in the art and include, but are not limited to, stable transformation methods, transient transformation methods, and virus-mediated methods. "Stable transformation" refers to transformation where the nucleotide construct of interest introduced into a plant integrates into the genome of the plant and is capable of being inherited by the progeny thereof "Transient transformation" is intended to mean that a sequence is introduced into the plant and is only temporally expressed or is only transiently present in the plant.

In an aspect, methods and compositions provided herein comprise a vector. As used herein, the terms "vector" or "plasmid" are used interchangeably and refer to a circular, double-stranded DNA molecule that is physically separate from chromosomal DNA. In an aspect, a plasmid or vector used herein is capable of replication in vivo. A "transformation vector," as used herein, is a plasmid that is capable of transforming a plant cell. In an aspect, a plasmid provided herein is a bacterial plasmid. In another aspect, a plasmid provided herein is an *Agrobacterium* Ti plasmid or derived from an *Agrobacterium* Ti plasmid.

In an aspect, a plasmid or vector provided herein is a recombinant vector. As used herein, the term "recombinant vector" refers to a vector formed by laboratory methods of genetic recombination, such as molecular cloning. In another aspect, a plasmid provided herein is a synthetic plasmid. As used herein, a "synthetic plasmid" is an artificially created plasmid that is capable of the same functions (e.g., replication) as a natural plasmid (e.g., Ti plasmid). Without being limited, one skilled in the art can create a synthetic plasmid de novo via synthesizing a plasmid by individual nucleotides, or by splicing together nucleic acid molecules from different pre-existing plasmids.

Vectors are commercially available or can be produced by recombinant DNA techniques routine in the art. A vector containing a nucleic acid can have expression elements operably linked to such a nucleic acid, and further can include sequences such as those encoding a selectable marker (e.g., an antibiotic resistance gene). A vector containing a nucleic acid can encode a chimeric or fusion polypeptide (i.e., a polypeptide operatively linked to a heterologous polypeptide, which can be at either the N-terminus or C-terminus of the polypeptide). Representative heterologous polypeptides are those that can be used in purification of the encoded polypeptide (e.g., 6×His tag (SEQ ID NO:45), glutathione S-transferase (GST)).

Suitable methods of introducing polynucleotides into plant cells of the present disclosure include microinjection (Crossway et al. (1986) *Biotechniques* 4:320-334), electroporation (Shillito et al. (1987) *Meth. Enzymol.* 153:313-336; Riggs et al. (1986) *Proc. Natl. Acad. Sci. USA* 83:5602-5606), *Agrobacterium*-mediated transformation (U.S. Pat. Nos. 5,104,310, 5,149,645, 5,177,010, 5,231,019, 5,463,174, 5,464,763, 5,469,976, 4,762,785, 5,004,863, 5,159,135, 5,563,055, and 5,981,840), direct gene transfer (Paszkowski et al. (1984) *EMBO J.* 3:2717-2722), and ballistic particle acceleration (see, for example, U.S. Pat. Nos. 4,945,050, 5,141,131, 5,886,244, 5,879,918, and 5,932,782; Tomes et al. (1995) in *Plant Cell*, Tissue, and Organ Culture Fundamental Methods, ed. Gamborg and Phillips (Springer-Verlag, Berlin); McCabe et al. (1988) *Biotechnology* 6:923-926). Also see Weising et al. (1988) *Ann. Rev. Genet.* 22:421-477; Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P: 175-182 (soybean); Singh et al. (1998) *Theor. Appl. Genet.* 96:319-324 (soybean); De Wet et al. (1985) in The Experimental Manipulation of Ovule Tissues, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation).

It is understood that any modified tobacco plant of the present disclosure can further comprise additional agronomically desirable traits, for example, by transformation with a genetic construct or transgene using a technique known in the art. Without limitation, an example of a desired trait is herbicide resistance, pest resistance, disease resistance, high yield, high grade index value, curability, curing quality, mechanical harvestability, holding ability, leaf quality, height, plant maturation (e.g., early maturing, early to medium maturing, medium maturing, medium to late maturing, or late maturing), stalk size (e.g., a small, medium, or a large stalk), or leaf number per plant (e.g., a small (e.g., 5-10 leaves), medium (e.g., 11-15 leaves), or large (e.g., 16-21) number of leaves), or any combination. In an aspect, a tobacco plant capable of producing cured leaf with reduced TSNA or seeds provided herein comprises one or more transgenes expressing one or more insecticidal proteins, such as, for example, a crystal protein of *Bacillus thuringiensis* or a vegetative insecticidal protein from *Bacillus cereus*, such as VIP3 (see, for example, Estruch et al. (1997) *Nat. Biotechnol.* 15:137). In another aspect, a tobacco plant provided herein further comprises an introgressed trait conferring resistance to brown stem rot (U.S. Pat. No. 5,689,035) or resistance to cyst nematodes (U.S. Pat. No. 5,491,081).

The level and/or activity of polypeptides provided herein may be modulated by employing a polynucleotide that is not capable of directing, in a transformed plant, the expression of a protein or an RNA. For example, the polynucleotides of the invention may be used to design polynucleotide constructs that can be employed in methods for altering or mutating a genomic nucleotide sequence in an organism. Such polynucleotide constructs include, but are not limited to, RNA:DNA vectors, RNA:DNA mutational vectors, RNA:DNA repair vectors, mixed-duplex oligonucleotides, self-complementary RNA:DNA oligonucleotides and recombinogenic oligonucleobases. Such nucleotide constructs and methods of use are known in the art. See, U.S. Pat. Nos. 5,565,350; 5,731,181; 5,756,325; 5,760,012; 5,795,972 and 5,871,984; each of which is incorporated herein by reference as if set forth in its entirety. See also, International Patent Application Publication Nos. WO 98/149350, WO 99/107865 and WO 99/125921; and Beetham et al. (1999) Proc. Natl. Acad. Sci. USA 96:8774-8778; each of which is incorporated herein by reference as if set forth in its entirety.

The present disclosure also provides compositions and methods for inhibiting the expression or function of one or more polypeptides that suppress, directly or indirectly, the production or accumulation of one or more antioxidants in a plant, particularly plants of the *Nicotiana* genus, including tobacco plants of various commercial varieties.

In an aspect, inhibition of the expression of one or more polypeptides (e.g., Nic1b_ERF or Nic2_ERF genes) provided herein may be obtained by RNA interference (RNAi) by expression of a transgene capable of producing an inhibitory sequence provided herein. In an aspect, RNAi comprises expressing a non-coding RNA. As used herein, a "non-coding RNA" is selected from the group consisting of a microRNA (miRNA), a small interfering RNA (siRNA), a trans-acting siRNA (ta-siRNA), a transfer RNA (tRNA), a ribosomal RNA (rRNA), an intron, a hairpin RNA (hpRNA), and an intron-containing hairpin RNA (ihpRNA). In an aspect, a single non-coding RNA provided herein inhibits the expression of at least 1, at least 2, at least 3, at least 4, at least 5, at least 6, at least 7, at least 8, at least 9, at least 10, or more than 10 polypeptides. In an aspect, a non-coding RNA provided herein is stably transformed into a plant genome. In another aspect, a non-coding RNA provided herein is transiently transformed into a plant genome.

As used herein, the terms "suppress," "inhibit," "inhibition," "inhibiting", and "downregulation" are defined as any method known in the art or described herein that decreases the expression or function of a gene product (e.g., an mRNA, a protein, a non-coding RNA). "Inhibition" can be in the context of a comparison between two cells, for example, a modified cell versus a control cell. Inhibition of expression or function of a gene product can also be in the context of a comparison between plant cells, organelles, organs, tissues, or plant components within the same plant or between different plants, and includes comparisons between developmental or temporal stages within the same plant or plant component or between plants or plant components. "Inhibition" includes any relative decrement of function or production of a gene product of interest, up to and including complete elimination of function or production of that gene product. The term "inhibition" encompasses any method or composition that down-regulates translation and/or transcription of the target gene product or functional activity of the target gene product. "Inhibition" need not comprise complete elimination of expression of a gene product. In an aspect, a gene product in a modified cell provided herein comprises expression that is at least 1%, at least 2%, at least 3%, at least 4%, at least 5%, at least 10%, at least 20%, at least 25%, at least 30%, at least 40%, at least 50%, at least 60%, at least 70%, at least 80%, at least 90%, at least 95%, or 100% lower than the expression of the gene product in a control cell. In another aspect, a gene product in a modified cell provided herein comprises expression that is between 1% and 100%, between 1% and 95%, between 1% and 90%, between 1% and 80%, between 1% and 70%, between 1% and 60%, between 1% and 50%, between 1% and 40%, between 1% and 30%, between 1% and 25%, between 1% and 20%, between 1% and 15%, between 1% and 10%, between 1% and 5%, between 5% and 25%, between 5% and 50%, between 5% and 75%, between 5% and 100%, between 10% and 25%, between 10% and 50%, between 10% and 75%, between 10% and 100%, between 25% and 50%, between 25% and 75%, between 25% and 100%, or between 50% and 100% lower than the expression of the gene product in a control cell.

As used herein, a "target site" refers to a location of a polynucleotide sequence that is bound to and cleaved by a site-specific nuclease introducing a double stranded break into the nucleic acid backbone. In another aspect a target site comprises at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 29, or at least 30 consecutive nucleotides. In another aspect, a target site provided herein is at least 10, at least 20, at least 30, at least 40, at least 50, at least 75, at least 100, at least 125, at least 150, at least 200, at least 250, at least 300, at least 400, or at least 500 nucleotides. In an aspect a site-specific nuclease binds to a target site. In another aspect a site-specific nuclease binds to a target site via a guiding non-coding RNA (i.e., such as, without being limiting, a CRISPR RNA or single-guide RNA (both described in detail below)). In an aspect, a non-coding RNA provided herein is complementary to a target site. It will be appreciated that perfect complementarity is not required for a non-coding RNA to bind to a target site; at least 1, at least 2, at least 3, at least 4, or at least 5, at least 6, at least 7 or at least 8 mismatches between a target site and a non-coding RNA can be tolerated. As used herein, a "target region" or a "targeted region" refers to a polynucleotide sequence that is desired to be modified. In an aspect, a "target region," "targeted region," or a "target gene" is flanked by two or more, three or more, four or more, five or more, six or more, seven or more, eight or more, nine or more, or ten or more target sites. A "target gene" refers to a polynucleotide sequence encoding a gene that is desired to be modified or from which transcript expression is desired to be modulated. In an aspect, a polynucleotide sequence comprising a target gene further comprises one or more target sites. In another aspect, a transgene is said to be targeting a target site or a target gene. In another aspect, a target region comprises one or more, two or more, three or more, four or more, five or more, six or more, seven or more, eight or more, nine or more, or ten or more target genes. Without being limiting, in an aspect a target region can be subject to deletion or inversion. As used herein, "flanked" when used to describe a target region, refers to two or more target sites physically surrounding the target region, with one target site on each side of the target region.

As used herein, "upstream" refers to a nucleic acid sequence that is positioned before the 5' end of a linked nucleic acid sequence. As used herein, "downstream" refers to a nucleic acid sequence is positioned after the 3' end of a linked nucleic acid sequence. As used herein, "5'" refers to the start of a coding DNA sequence or the beginning of an RNA molecule. As used herein, "3'" refers to the end of a coding DNA sequence or the end of an RNA molecule. It will be appreciated that an "inversion" refers to reversing the orientation of a given polynucleotide sequence. For example, if the sample sequence 5'-ATGATC-3' is inverted it will read 5'-CTAGTA-3' in reverse orientation. Additionally, the sample sequence 5'-ATGATC-3' is considered to be in "opposite orientation" to the sample sequence 5'-CTAGTA-3'.

In another aspect, recombinant constructs or expression cassettes may be introduced into plants by contacting plants with a virus or viral nucleic acids. Generally, such methods involve incorporating an expression cassette of the present disclosure within a viral DNA or RNA molecule. It is recognized that promoters for use in expression cassettes also encompass promoters utilized for transcription by viral RNA polymerases. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316,931, and Porta et al. (1996) *Molecular Biotechnology* 5:209-221.

As used herein, "locus" is a chromosome region where a polymorphic nucleic acid, trait determinant, gene, or marker is located. The loci of this disclosure comprise one or more polymorphisms in a population; e.g., alternative alleles are present in some individuals. As used herein, "allele" refers to an alternative nucleic acid sequence at a particular locus. The length of an allele can be as small as 1 nucleotide base, but is typically larger. For example, a first allele can occur on one chromosome, while a second allele occurs on a second homologous chromosome, e.g., as occurs for different chromosomes of a heterozygous individual, or between different homozygous or heterozygous individuals in a population. As used herein, a chromosome in a diploid plant is "hemizygous" when only one copy of a locus is present. For example, an inserted transgene is hemizygous when it only inserts into one sister chromosome (i.e., the second sister chromosome does not contain the inserted transgene).

In an aspect, a modified plant, seed, plant component, plant cell, or plant genome is homozygous for a transgene provided herein. In another aspect, a modified plant, seed, plant component, plant cell, or plant genome is heterozygous for a transgene provided herein. In an aspect, a modified plant, seed, plant component, plant cell, or plant genome is hemizygous for a transgene provided herein. In an aspect, a modified plant, seed, plant component, plant cell, or plant genome is homozygous for a mutation provided herein. In another aspect, a modified plant, seed, plant component, plant cell, or plant genome is heterozygous for a mutation provided herein. In an aspect, a modified plant, seed, plant component, plant cell, or plant genome is hemizygous for a mutation provided herein.

As used herein, "introgression" or "introgress" refers to the transmission of a desired allele of a genetic locus from one genetic background to another.

As used herein, "crossed" or "cross" means to produce progeny via fertilization (e.g. cells, seeds or plants) and includes crosses between different plants (sexual) and self-fertilization (selfing).

As used herein, "backcross" and "backcrossing" refer to the process whereby a progeny plant is repeatedly crossed back to one of its parents. In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. The initial cross gives rise to the $F_1$ generation. The term "$BC_1$" refers to the second use of the recurrent parent, "$BC_2$" refers to the third use of the recurrent parent, and so on. In an aspect, a backcross is performed repeatedly, with a progeny individual of each successive backcross generation being itself backcrossed to the same parental genotype.

As used herein, "elite variety" means any variety that has resulted from breeding and selection for superior agronomic performance.

As used herein, "selecting" or "selection" in the context of breeding refer to the act of picking or choosing desired individuals, normally from a population, based on certain pre-determined criteria.

In an aspect, a tobacco plant provided herein is a hybrid plant. Hybrids can be produced by preventing self-pollination of female parent plants (e.g., seed parents) of a first variety, permitting pollen from male parent plants of a second variety to fertilize the female parent plants, and allowing $F_1$ hybrid seeds to form on the female plants. Self-pollination of female plants can be prevented by emasculating the flowers at an early stage of flower development. Alternatively, pollen formation can be prevented on the female parent plants using a form of male sterility. For example, male sterility can be produced by male sterility (MS), or transgenic male sterility where a transgene inhibits microsporogenesis and/or pollen formation, or self-incompatibility. Female parent plants containing MS are particularly useful. In aspects in which the female parent plants are MS, pollen may be harvested from male fertile plants and applied manually to the stigmas of MS female parent plants, and the resulting $F_1$ seed is harvested. Additionally, female sterile plants can also be used to prevent self-fertilization.

Plants can be used to form single-cross tobacco $F_1$ hybrids. Pollen from a male parent plant is manually transferred to an emasculated female parent plant or a female parent plant that is male sterile to form $F_1$ seed. Alternatively, three-way crosses can be carried out where a single-cross $F_1$ hybrid is used as a female parent and is crossed with a different male parent. As another alternative, double-cross hybrids can be created where the $F_1$ progeny of two different single-crosses are themselves crossed. Self-incompatibility can be used to particular advantage to prevent self-pollination of female parents when forming a double-cross hybrid.

In an aspect, a tobacco variety provided herein is male sterile. In another aspect, a tobacco variety provided herein is cytoplasmic male sterile (CMS). Male sterile tobacco plants may be produced by any method known in the art. Methods of producing male sterile tobacco are described in Wernsman, E. A., and Rufty, R. C. 1987. Chapter Seventeen. Tobacco. Pages 669-698 In: Cultivar Development. Crop Species. W. H. Fehr (ed.), MacMillan Publishing Go., Inc., New York, N.Y. 761 pp. In another aspect, a tobacco variety provided herein is female sterile. As a non-limiting example, female sterile plants can be made by mutating the STIG1 gene. See, for example, Goldman et al. 1994, *EMBO Journal* 13:2976-2984.

As used herein, the term "sequence identity" or "identity" in the context of two polynucleotide or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity." For any protein sequences provided here, also contemplated are functional homolog proteins that differ in one or more amino acids as a result of one or more of well-known conservative amino acid substitutions, e.g., valine is a conservative substitute for alanine and threonine is a conservative substitute for serine. Conservative substitutions for an amino acid within the native sequence can be selected from other members of a class to which the naturally occurring amino acid belongs. Representative amino acids within these various classes include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. A further aspect of the disclosure includes proteins that differ in one or more amino acids from those of a described protein sequence as the result of deletion or insertion of one or more amino acids in a native sequence.

Nucleic acid molecules, polypeptides, or proteins provided can be isolated or substantially purified. An "isolated" or "purified" nucleic acid molecule, polypeptide, protein, or biologically active portion thereof, is substantially or essentially free from components that normally accompany or interact with the polynucleotide or protein as found in its naturally occurring environment. For example, an isolated or purified polynucleotide or protein is substantially free of other cellular material, or culture medium when produced by recombinant techniques, or substantially free of chemical precursors or other chemicals when chemically synthesized.

In an aspect, this disclosure provides methods of detecting in plant cells one or more recombinant nucleic acids and polypeptides described here. Without being limiting, nucleic acids also can be detected using hybridization. Hybridization between nucleic acids is discussed in detail in Sambrook et al. (1989, Molecular Cloning: A Laboratory Manual, 2nd Ed., Cold Spring Harbor Laboratory Press, Cold Spring Harbor, NY).

Polypeptides can be detected using antibodies. Techniques for detecting polypeptides using antibodies include enzyme linked immunosorbent assays (ELISAs), Western blots, immunoprecipitations and immunofluorescence. An antibody provided herein can be a polyclonal antibody or a monoclonal antibody. An antibody having specific binding affinity for a polypeptide provided herein can be generated using methods well known in the art. An antibody provided herein can be attached to a solid support such as a microtiter plate using methods known in the art.

Detection (e.g., of an amplification product, of a hybridization complex, of a polypeptide) can be accomplished using detectable labels. The term "label" is intended to encompass the use of direct labels as well as indirect labels. Detectable labels include enzymes, prosthetic groups, fluorescent materials, luminescent materials, bioluminescent materials, and radioactive materials.

Any plant tissue that can be subsequently propagated using clonal methods, whether by organogenesis or embryogenesis, may be transformed with a recombinant construct or an expression cassette. By "organogenesis" in intended the process by which shoots and roots are developed sequentially from meristematic centers. By "embryogenesis" is intended the process by which shoots and roots develop together in a concerted fashion (not sequentially), whether from somatic cells or gametes. Exemplary tissues that are suitable for various transformation protocols described include, but are not limited to, callus tissue, existing meristematic tissue (e.g., apical meristems, axillary buds, and root meristems) and induced meristem tissue (e.g., cotyledon meristem and hypocotyl meristem), hypocotyls, cotyledons, leaf disks, pollen, embryos, and the like.

In an aspect, a tobacco plant provided is from a tobacco type selected from the group consisting of flue-cured tobacco, air-cured tobacco, dark air-cured tobacco, dark fire-cured tobacco, *Galpao* tobacco, and Oriental tobacco. In another aspect, a tobacco plant provided is from a tobacco type selected from the group consisting of Burley tobacco, Maryland tobacco, and dark tobacco.

In an aspect, a tobacco plant provided is in a flue-cured tobacco background or exhibits one or more flue-cured tobacco characteristic described here. Flue-cured tobaccos (also called Virginia or bright tobaccos) amount to approximately 40% of world tobacco production. Flue-cured tobaccos are often also referred to as "bright tobacco" because of the golden-yellow to deep-orange color it reaches during curing. Flue-cured tobaccos have a light, bright aroma and taste. Flue-cured tobaccos are generally high in sugar and low in oils. Major flue-cured tobacco growing countries are Argentina, Brazil, China, India, Tanzania and the U.S. In an aspect, a low-alkaloid or low-nicotine tobacco plant or seed provided is in a flue-cured tobacco background selected from the group consisting of CC 13, CC 27, CC 33, CC 37, CC 65, CC 67, CC 700, GF 318, GL 338, GL 368, GL 939, K 346, K 399, K326, NC 102, NC 196, NC 291, NC 297, NC 299, NC 471, NC 55, NC 606, NC 71, NC 72, NC 92, PVH 1118, PVH 1452, PVH 2110, SPEIGHT 168, SPEIGHT 220, SPEIGHT 225, SPEIGHT 227, SPEIGHT 236, and any variety essentially derived from any one of the foregoing varieties. In another aspect, a low-alkaloid or low-nicotine tobacco plant or seed provided is in a flue-cured tobacco background selected from the group consisting of Coker 48, Coker 176, Coker 371-Gold, Coker 319, Coker 347, GL 939, K 149, K326, K 340, K 346, K 358, K 394, K 399, K 730, NC 27NF, NC 37NF, NC 55, NC 60, NC 71, NC 72, NC 82, NC 95, NC 297, NC 606, NC 729, NC 2326, McNair 373, McNair 944, Ox 207, Ox 414 NF, Reams 126, Reams 713, Reams 744, RG 8, RG 11, RG 13, RG 17, RG 22, RG 81, RG H4, RG H51, Speight H-20, Speight G-28, Speight G-58, Speight G-70, Speight G-108, Speight G-111, Speight G-117, Speight 168, Speight 179, Speight NF-3, Va 116, Va 182, and any variety essentially derived from any one of the foregoing varieties. See WO 2004/041006 A1. In a further aspect, low-alkaloid or low-nicotine tobacco plants, seeds, hybrids, varieties, or lines are in any flue cured background selected from the group consisting of K326, K346, and NC196. In an aspect, tobacco plants or seeds or modified tobacco plants or seeds provided herein are of a flue-cured tobacco variety selected from the group consisting of the varieties listed in Table 1, and any variety essentially derived from any one of the foregoing varieties. See WO 2004/041006 A1. In a further aspect, modified tobacco plants or seeds provided herein are in a flue-cured variety selected from the group consisting of K326, K346, and NC196.

TABLE 1

| Flue-cured Tobacco Varieties. |
|---|
| 400 (TC 225) |
| 401 (TC 226) |
| 401 Cherry Red (TC 227) |
| 401 Cherry Red Free (TC 228) |
| Cash (TC 250) |
| Cash (TI 278) |
| CC 101 |
| CC 1063 |
| CC 13 |
| CC 143 |
| CC 200 |
| CC 27 |
| CC 301 |
| CC 33 |
| CC 35 |
| CC 37 |
| CC 400 |
| CC 500 |
| CC 600 |
| CC 65 |
| CC 67 |
| CC 700 |
| CC 800 |
| CC 900 |
| Coker 139 (TC 259) |
| Coker 139 yb1, yb2 |
| Coker 140 (TC 260) |
| Coker 176 (TC 262) |
| Coker 187 (TC 263) |
| Coker 187-Hicks (TC 265) |
| Coker 209 (TC 267) |
| Coker 258 (TC 270) |
| Coker 298 (TC 272) |
| Coker 316 (TC 273) |
| Coker 319 (TC 274) |
| Coker 347 (TC 275) |
| Coker 371-Gold (TC 276) |
| Coker 411 (TC 277) |
| Coker 48 (TC 253) |
| Coker 51 (TC 254) |
| Coker 86 (TC 256) |
| CU 263 (TC 619) |
| CU 561 |
| DH95-1562-1 |
| Dixie Bright 101 (TC 290) |
| Dixie Bright 102 (TC 291) |
| Dixie Bright 244 (TC 292) |
| Dixie Bright 27 (TC 288) |
| Dixie Bright 28 (TC 289) |
| GF 157 |
| GF 318 |
| GL 26H |
| GL 338 |
| GL 350 |
| GL 368 |
| GL 395 |
| GL 600 |
| GL 737 |
| GL 939 |
| GL 939 (TC 628) |
| Hicks (TC 310) |
| Hicks Broadleaf (TC 311) |
| K 149 (TC 568) |
| K 317 |

TABLE 1-continued

| Flue-cured Tobacco Varieties. |
|---|
| K 326 |
| K 326 (TC 319) |
| K 340 (TC 320) |
| K 346 |
| K 346 (TC 569) |
| K 358 |
| K 394 (TC 321) |
| K 399 |
| K 399 (TC 322) |
| K 730 |
| Lonibow (TI 1573) |
| Lonibow (TI 1613) |
| McNair 10 (TC 330) |
| McNair 135 (TC 337) |
| McNair 30 (TC 334) |
| McNair 373 (TC 338) |
| McNair 944 (TC 339) |
| MK94 (TI 1512) |
| MS K 326 |
| MS NC 71 |
| MS NC 72 |
| NC 100 |
| NC 102 |
| NC 1071 (TC 364) |
| NC 1125-2 |
| NC 12 (TC 346) |
| NC 1226 |
| NC 196 |
| NC 2326 (TC 365) |
| NC 27 NF (TC 349) |
| NC 291 |
| NC 297 |
| NC 299 |
| NC 37 NF (TC 350) |
| NC 471 |
| NC 55 |
| NC 567 (TC 362) |
| NC 60 (TC 352) |
| NC 606 |
| NC 6140 |
| NC 71 |
| NC 72 |
| NC 729 (TC 557) |
| NC 810 (TC 659) |
| NC 82 (TC 356) |
| NC 8640 |
| NC 89 (TC 359) |
| NC 92 |
| NC 925 |
| NC 95 (TC 360) |
| NC 98 (TC 361) |
| NC EX 24 |
| NC PY 10 (TC 367) |
| NC TG 61 |
| Oxford 1 (TC 369) |
| Oxford 1-181 (TC 370) |
| Oxford 2 (TC 371) |
| Oxford 207 (TC 632) |
| Oxford 26 (TC 373) |
| Oxford 3 (TC 372) |
| Oxford 414 NF |
| PD 611 (TC 387) |
| PVH 03 |
| PVH 09 |
| PVH 1118 |
| PVH 1452 |
| PVH 1600 |
| PVH 2110 |
| PVH 2275 |
| R 83 (Line 256-1)(TI 1400) |
| Reams 134 |
| Reams 158 |
| Reams 713 |
| Reams 744 |
| Reams M1 |
| RG 11 (TC 600) |
| RG 13 (TC 601) |
| RG 17 (TC 627) |

TABLE 1-continued

| Flue-cured Tobacco Varieties. |
|---|
| RG 22 (TC 584) |
| RG 8 (TC 585) |
| RG 81 (TC 618) |
| RG H51 |
| RG4H 217 |
| RGH 12 |
| RGH 4 |
| RGH 51 |
| RGH 61 |
| SC 58 (TC 400) |
| SC 72 (TC 403) |
| Sp. G-168 |
| SPEIGHT 168 |
| Speight 168 (TC 633) |
| Speight 172 (TC 634) |
| Speight 178 |
| Speight 179 |
| Speight 190 |
| Speight 196 |
| SPEIGHT 220 |
| SPEIGHT 225 |
| SPEIGHT 227 |
| SPEIGHT 236 |
| Speight G-10 (TC 416) |
| Speight G-102 |
| Speight G-108 |
| Speight G-111 |
| Speight G-117 |
| Speight G-126 |
| Speight G-15 (TC 418) |
| Speight G-23 |
| Speight G-28 (TC 420) |
| Speight G-33 |
| Speight G-41 |
| Speight G-5 |
| Speight G-52 |
| Speight G-58 |
| Speight G-70 |
| Speight G-70 (TC 426) |
| Speight G-80 (TC 427) |
| Speight NF3 (TC 629) |
| STNCB |
| VA 182 |
| VA 45 (TC 559) |
| Vesta 30 (TC 439) |
| Vesta 33 (TC 440) |
| Vesta 5 (TC 438) |
| Vesta 62 (TC 441) |
| Virginia (TI 220) |
| Virginia (TI 273) |
| Virginia (TI 877) |
| Virginia 115 (TC 444) |
| Virginia 21 (TC 443) |
| Virginia Bright (TI 964) |
| Virginia Bright Leaf (TC 446) |
| Virginia Gold (TC 447) |
| White Stem Orinoco (TC 451) |

In an aspect, a tobacco plant provided is in an air-cured tobacco background or exhibits one or more air-cured tobacco characteristic described here. Air-cured tobaccos include Burley, Maryland, and dark tobaccos. The common factor is that curing is primarily without artificial sources of heat and humidity. Burley tobaccos are light to dark brown in color, high in oil, and low in sugar. Burley tobaccos are air-cured in barns. Major Burley growing countries are Argentina, Brazil, Italy, Malawi, and the U.S. Maryland tobaccos are extremely fluffy, have good burning properties, low nicotine and a neutral aroma. Major Maryland growing countries include the U.S. and Italy. In an aspect, a low-alkaloid or low-nicotine tobacco plant or seed provided is in a Burley tobacco background selected from the group consisting of Clay 402, Clay 403, Clay 502, Ky 14, Ky 907, Ky 910, Ky 8959, NC 2, NC 3, NC 4, NC 5, NC 2000, TN 86, TN 90, TN 97, R 610, R 630, R 711, R 712, NCBH 129, Bu 21×Ky 10, HB04P, Ky 14×L 8, Kt 200, Newton 98, Pedigo 561, Pf561 and Va 509. In a further aspect, low-alkaloid or low-nicotine tobacco plants, seeds, hybrids, varieties, or lines are in any Burley background selected from the group consisting of TN 90, KT 209, KT 206, KT212, and HB 4488. In one aspect, tobacco plants or seeds or modified tobacco plants or seeds provided herein are of a Burley tobacco variety selected from the group consisting of the tobacco varieties listed in Table 2, and any variety essentially derived from any one of the foregoing varieties. In a further aspect, modified tobacco plants or seeds provided herein are in a Burley variety selected from the group consisting of TN 90, KT 209, KT 206, KT212, and HB 4488.

TABLE 2

| Burley Tobacco Varieties. |
|---|
| 4407 LC |
| AA-37-1 |
| Burley 21 (TC 7) |
| Burley 49 (TC 10) |
| Burley 64 (TC 11) |
| Burley Mammoth KY 16 (TC 12) |
| Clay 402 |
| Clay 403 |
| Clay 502 |
| Clays 403 |
| GR 10 (TC 19) |
| GR 10 (TC 19) |
| GR 10A (TC 20) |
| GR 13 (TC 21) |
| GR 14 (TC 22) |
| GR 149 LC |
| GR 153 |
| GR 17 (TC 23) |
| GR 17B (TC 24) |
| GR 18 (TC 25) |
| GR 19 (TC 26) |
| GR 2 (TC 15) |
| GR 24 (TC 27) |
| GR 36 (TC 28) |
| GR 38 (TC 29) |
| GR 38A (TC 30) |
| GR 40 (TC 31) |
| GR 42 (TC 32) |
| GR 42C (TC 33) |
| GR 43 (TC 34) |
| GR 44 (TC 35) |
| GR 45 (TC 36) |
| GR 46 (TC 37) |
| GR 48 (TC 38) |
| GR 5 (TC 16) |
| GR 53 (TC 39) |
| GR 6 (TC 17) |
| GR 9 (TC 18) |
| GR 139 NS |
| GR 139 S |
| HB 04P |
| HB 04P LC |
| HB 3307P LC |
| HB 4108P |
| HB 4151P |
| HB 4192P |
| HB 4194P |
| HB 4196 |
| HB 4488 |
| HB 4488P |
| HB04P |
| HB 4488 LC |
| HIB 21 |
| HPB 21 |
| HY 403 |
| Hybrid 403 LC |
| Hybrid 404 LC |
| Hybrid 501 LC |
| KDH-959 (TC 576) |

TABLE 2-continued

| Burley Tobacco Varieties. |
|---|
| KDH-960 (TC 577) |
| KT 200 LC |
| KT 204 LC |
| KT 206 LC |
| KT 209 LC |
| KT 210 LC |
| KT 212 LC |
| KT 215 LC |
| KY 1 (TC 52) |
| KY 10 (TC 55) |
| KY 12 (TC 56) |
| KY 14 (TC 57) |
| KY 14 x L8 LC |
| KY 15 (TC 58) |
| KY 16 (TC 59) |
| KY 17 (TC 60) |
| KY 19 (TC 61) |
| KY 21 (TC 62) |
| KY 22 (TC 63) |
| KY 24 (TC 64) |
| KY 26 (TC 65) |
| KY 33 (TC 66) |
| KY 34 (TC 67) |
| KY 35 (TC 68) |
| KY 41A (TC 69) |
| KY 5 (TC 53) |
| KY 52 (TC 70) |
| KY 54 (TC 71) |
| KY 56 (TC 72) |
| KY 56 (TC 72) |
| KY 57 (TC 73) |
| KY 58 (TC 74) |
| KY 8654 (TC 77) |
| KY 8959 |
| KY 9 (TC 54) |
| KY 907 LC |
| KY 908 (TC 630) |
| NBH 98 (Screened) |
| NC 1206 |
| NC 129 |
| NC 2000 LC |
| NC 2002 LC |
| NC 3 LC |
| NC 5 LC |
| NC 6 LC |
| NC 7 LC |
| NC BH 129 LC |
| NC03-42-2 |
| Newton 98 |
| R 610 LC |
| R 630 LC |
| R 7-11 |
| R 7-12 LC |
| RG 17 |
| TKF 1801 LC |
| TKF 2002 LC |
| TKF 4024 LC |
| TKF 4028 LC |
| TKF 6400 LC |
| TKF 7002 LC |
| TKS 2002 LC |
| TN 86 (TC 82) |
| TN 90 LC |
| TN 97 Hybrid LC |
| TN 97 LC |
| VA 116 |
| VA 119 |
| Virgin A Mutante (TI 1406) |
| Virginia 509 (TC 84) |

In another aspect, a low-alkaloid or low-nicotine tobacco plant or seed provided is in a Maryland tobacco background selected from the group consisting of Md 10, Md 40, Md 201, Md 609, Md 872 and Md 341. In another aspect, tobacco plants or seeds or modified tobacco plants or seeds provided herein are of a Maryland tobacco variety selected from the group consisting of the tobacco varieties listed in Table 3, and any variety essentially derived from any one of the foregoing varieties.

TABLE 3

| Maryland Tobacco Varieties. |
|---|
| Maryland 10 (TC 498) |
| Maryland 14 D2 (TC 499) |
| Maryland 201 (TC 503) |
| Maryland 21 (TC 500) |
| Maryland 341 (TC 504) |
| Maryland 40 |
| Maryland 402 |
| Maryland 59 (TC 501) |
| Maryland 601 |
| Maryland 609 (TC 505) |
| Maryland 64 (TC 502) |
| Maryland 872 (TC 506) |
| Maryland Mammoth (TC 507) |

In an aspect, a tobacco plant provided is in a dark air-cured tobacco background or exhibits one or more dark air-cured tobacco characteristic described here. Dark air-cured tobaccos are distinguished from other types primarily by its curing process which gives dark air-cured tobacco its medium- to dark-brown color and distinct aroma. Dark air-cured tobaccos are mainly used in the production of chewing tobacco and snuff. In an aspect, a low-alkaloid or low-nicotine tobacco plant or seed provided is in a dark air-cured tobacco background selected from the group consisting of Sumatra, Jatim, Dominican Cubano, Besuki, One sucker, Green River, Virginia sun-cured, and Paraguan Passado, and any variety essentially derived from any one of the foregoing varieties.

In an aspect, a tobacco plant provided is in a dark fire-cured tobacco background or exhibits one or more dark fire-cured tobacco characteristic described here. Dark fire-cured tobaccos are generally cured with low-burning wood fires on the floors of closed curing barns. Their leaves have low sugar content but high nicotine content. Dark fire-cured tobaccos are used for making pipe blends, cigarettes, chewing tobacco, snuff and strong-tasting cigars. Major growing regions for dark fire-cured tobaccos are Tennessee, Kentucky, and Virginia, USA. In an aspect, a low-alkaloid or low-nicotine tobacco plant or seed provided is in a dark fire-cured tobacco background selected from the group consisting of Narrow Leaf Madole, Improved Madole, Tom Rosson Madole, Newton's VH Madole, Little Crittenden, Green Wood, Little Wood, Small Stalk Black Mammoth, DT 508, DT 518, DT 592, KY 171, DF 911, DF 485, TN D94, TN D950, VA 309, and VA 359. In one aspect, tobacco plants or seeds or modified tobacco plants or seeds provided herein are of a dark fire-cured tobacco variety selected from the group consisting of the tobacco varieties listed in Table 4, and any variety essentially derived from any one of the foregoing varieties.

TABLE 4

| Dark Fire-Cured Tobacco Varieties. |
|---|
| Black Mammoth (TC 461) |
| Black Mammoth Small Stalk (TC 641) |
| Certified Madole (TC 463) |
| D-534-A-1 (TC 464) |
| DAC ULT 302 |
| DAC ULT 303 |
| DAC ULT 306 |
| DAC ULT 308 |

TABLE 4-continued

| Dark Fire-Cured Tobacco Varieties. |
| --- |
| DAC ULT 312 |
| DF 300 (TC 465) |
| DF 485 (TC 466) |
| DF 516 (TC 467) |
| DF 911 (TC 468) |
| DT 508 |
| DT 518 (Screened) |
| DT 538 LC |
| DT 592 |
| Improved Madole (TC 471) |
| Jernigan's Madole (TC 472) |
| KT 14LC |
| KT D17LC |
| KT D4 LC |
| KT D6 LC |
| KT D8 LC |
| KY 153 (TC 216) |
| KY 157 (TC 217) |
| KY 160 |
| KY 160 (TC 218) |
| KY 163 (TC 219) |
| KY 165 (TC 220) |
| KY 170 (TC 474) |
| KY 171 (PhPh) |
| KY 171 (TC 475) |
| KY 171 LC |
| KY 171 NS |
| KY 180 (TC 573) |
| KY 190 (TC 574) |
| Little Crittenden |
| Little Crittenden (TC 476) |
| Little Crittenden LC (certified) |
| Little Crittenden PhPh |
| Lizard Tail Turtle Foot |
| Madole (TC 478) |
| Madole (TC 479) |
| MS KY 171 |
| MS NL Madole LC |
| MS TN D950 LC |
| Nance (TC 616) |
| Narrow Leaf Madole LC (certified) |
| Neal Smith Madole (TC 646) |
| Newtons VH Madole |
| NL Madole |
| NL Madole (PhPh) |
| NL Madole (TC 484) |
| NL Madole LC |
| NL Madole LC (PhPh) |
| NL Madole NS |
| One Sucker (TC 224) |
| OS 400 |
| PD 302H |
| PD 312H |
| PD 318H |
| PD 7302 LC |
| PD 7305 |
| PD 7309 LC |
| PD 7312 LC |
| PD 7318 LC |
| PD 7319 LC |
| Petico M PG04 |
| PY KY 160 (TC 612) |
| PY KY 171 (TC 613) |
| Shirey |
| TI 1372 |
| TN D94 |
| TN D94 (TC 621) |
| TN D950 |
| TN D950 (PhPh) |
| TN D950 |
| TN D950 (TC 622) |
| TR Madole (TC 486) |
| VA 309 |
| VA 309 (TC 560) |
| VA 309 LC (certified) |
| VA 310 (TC 487) |
| VA 331 (TC 592) |
| VA 355 (TC 638) |
| VA 359 |
| VA 359 (Screened) |
| VA 359 (TC 639) |
| VA 359 LC (certified) |
| VA 403 (TC 580) |
| VA 405 (TC 581) |
| VA 409 (TC 562) |
| VA 510 (TC 572) |

In an aspect, a tobacco plant provided is in an Oriental tobacco background or exhibits one or more Oriental tobacco characteristic described here. Oriental tobaccos are also referred to as Greek, aroma and Turkish tobaccos due to the fact that they are typically grown in eastern Mediterranean regions such as Turkey, Greece, Bulgaria, Macedonia, Syria, Lebanon, Italy, and Romania. The small plant and leaf size, characteristic of today's Oriental varieties, as well as its unique aroma properties are a result of the plant's adaptation to the poor soil and stressful climatic conditions in which it develop over many past centuries. In an aspect, a low-alkaloid or low-nicotine tobacco plant or seed provided is in an Oriental tobacco background selected from the group consisting of Izmir, Katerini, Samsun, Basma and Krumovgrad, Trabzon, Thesalian, Tasova, Sinop, Izmit, Hendek, Edirne, Semdinli, Adiyanman, Yayladag, Iskenderun, Duzce, Macedonian, Mavra, Prilep, Bafra, Bursa, Bucak, Bitlis, Balikesir, and any variety essentially derived from any one of the foregoing varieties. In one aspect, tobacco plants or seeds or modified tobacco plants or seeds provided herein are of an Oriental tobacco variety selected from the group consisting of the tobacco varieties listed in Table 5, and any variety essentially derived from any one of the foregoing varieties.

TABLE 5

| Oriental Tobacco Varieties. |
| --- |
| Bafra (TI 1641) |
| Bahce (TI 1730) |
| Bahia (TI 1416) |
| Bahia (TI 1455) |
| Baiano (TI 128) |
| Basma |
| Basma (TI 1666) |
| Basma Drama |
| Basma Hybrid (PhPh) |
| Basma Zihna I |
| Bitlis (TI 1667) |
| Bitlis (TI 1725) |
| Bubalovac (TI 1282) |
| Bursa (TI 1650) |
| Bursa (TI 1668) |
| Canik (TI 1644) |
| Djebel 174 (TI 1492) |
| Djebel 359 (TI 1493) |
| Djebel 81 |
| Dubec 566 (TI 1409) |
| Dubec 7 (TI 1410) |
| Dubek 566 (TI 1567) |
| Duzce (TI 1670) |
| Edirne (TI 1671) |
| Ege (TI 1642) |
| Ege-64 (TI 1672) |
| Izmir (Akhisar) (TI 1729) |
| Izmir (Gavurkoy) (TI 1727) |
| Izmir Ege 64 |
| Izmir-Incekara (TI 1674) |
| Izmir-Ozbas (TI 1675) |
| Jaka Dzebel (TI 1326) |

TABLE 5-continued

| Oriental Tobacco Varieties. |
| --- |
| Kaba-Kulak |
| Kagoshima Maruba (TI 158) |
| Katerini |
| Katerini S53 |
| Krumovgrad 58 |
| MS Basma |
| MS Katerini S53 |
| Nevrokop 1146 |
| Ozbas (TI 1645) |
| Perustitza (TI 980) |
| Prilep (TI 1291) |
| Prilep (TI 1325) |
| Prilep 12-2/1 |
| Prilep 23 |
| Samsun (TC 536) |
| Samsun 959 (TI 1570) |
| Samsun Evkaf (TI 1723) |
| Samsun Holmes NN (TC 540) |
| Samsun Maden (TI 1647) |
| Samsun NO 15 (TC 541) |
| Samsun-BLK SHK Tol (TC 542) |
| Samsun-Canik (TI 1678) |
| Samsun-Maden (TI 1679) |
| Saribaptar 407 Izmir Region |
| Smyrna (TC 543) |
| Smyrna No. 23 (TC 545) |
| Smyrna No. 9 (TC 544) |
| Smyrna-Blk Shk Tol (TC 546) |
| Trabzon (TI 1649) |
| Trabzon (TI 1682) |
| Trapezund 161 (TI 1407) |
| Turkish (TC 548) |
| Turkish Angshit (TI 90) |
| Turkish Samsum (TI 92) |
| Turkish Tropizoid (TI 93) |
| Turkish Varotic (TI 89) |
| Xanthi (TI 1662) |

In an aspect, tobacco plants or seeds or modified tobacco plants or seeds provided herein are of an cigar tobacco variety selected from the group consisting of the tobacco varieties listed in Table 6, and any variety essentially derived from any one of the foregoing varieties.

TABLE 6

| Cigar Tobacco Varieties |
| --- |
| Bahai (TI 62) |
| Beinhart 1000 |
| Beinhart 1000 (TI 1562) |
| Beinhart 1000-1 (TI 1561) |
| Bergerac C |
| Bergerac C (TI 1529) |
| Big Cuban (TI 1565) |
| Castillo Negro, Blanco, Pina (TI 448) |
| Castillo Negro, Blanco, Pina (TI 448A) |
| Castillo Negro, Blanco, Pina (TI 449) |
| Caujaro (TI 893) |
| Chocoa (TI 289) |
| Chocoa (TI 313) |
| Connecticut 15 (TC 183) |
| Connecticut Broadleaf |
| Connecticut Broadleaf (TC 186) |
| Connecticut Shade (TC 188) |
| Criollo, Colorado (TI 1093) |
| Enshu (TI 1586) |
| Florida 301 |
| Florida 301 (TC 195) |
| PA Broadleaf (TC 119) |
| Pennsylvania Broadleaf |
| Pennsylvania Broadleaf (TC 119) |
| Petite Havana SR1 |
| Petite Havana SR1 (TC 105) |

In an aspect, tobacco plants or seeds or modified tobacco plants or seeds provided herein are of a tobacco variety selected from the group consisting of the tobacco varieties listed in Table 7, and any variety essentially derived from any one of the foregoing varieties.

TABLE 7

| Other Tobacco Varieties |
| --- |
| Chocoa (TI 319) |
| Hoja Parada (TI 1089) |
| Hoja Parado (Galpoa) (TI 1068) |
| Perique (St. James Parrish) |
| Perique (TC 556) |
| Perique (TI 1374) |
| Sylvestris (TI 984) |
| TI 179 |

In an aspect, a modified tobacco plant, seed, or cell described here is from a variety selected from the group consisting of the tobacco varieties listed in Table 1, Table 2, Table 3, Table 4, Table 5, Table 6, and Table 7.

In an aspect, low-alkaloid or low-nicotine tobacco plants, seeds, hybrids, varieties, or lines are essentially derived from or in the genetic background of BU 64, CC 101, CC 200, CC 27, CC 301, CC 400, CC 500, CC 600, CC 700, CC 800, CC 900, Coker 176, Coker 319, Coker 371 Gold, Coker 48, CU 263, DF911, *Galpao* tobacco, GL 26H, GL 350, GL 600, GL 737, GL 939, GL 973, HB 04P, K 149, K 326, K 346, K 358, K394, K 399, K 730, KDH 959, KT 200, KT204LC, KY 10, KY 14, KY 160, KY 17, KY 171, KY 907, KY907LC, KTY14×L8 LC, Little Crittenden, McNair 373, McNair 944, msKY 14×L8, Narrow Leaf Madole, NC 100, NC 102, NC 2000, NC 291, NC 297, NC 299, NC 3, NC 4, NC 5, NC 6, NC7, NC 606, NC 71, NC 72, NC 810, NC BH 129, NC 2002, Neal Smith Madole, OXFORD 207, 'Perique' tobacco, PVH03, PVH09, PVH19, PVH50, PVH51, R 610, R 630, R 7-11, R 7-12, RG 17, RG 81, RG H51, RGH 4, RGH 51, RS 1410, Speight 168, Speight 172, Speight 179, Speight 210, Speight 220, Speight 225, Speight 227, Speight 234, Speight G-28, Speight G-70, Speight H-6, Speight H20, Speight NF3, TI 1406, TI 1269, TN 86, TN86LC, TN 90, TN 97, TN97LC, TN D94, TN D950, TR (Tom Rosson) Madole, VA 309, or VA359, Maryland 609, HB3307PLC, HB4488PLC, KT206LC, KT209LC, KT210LC, KT212LC, R610LC, PVH2310, NC196, KTD14LC, KTD6LC, KTD8LC, PD7302LC, PD7305LC, PD7309LC, PD7318LC, PD7319LC, PD7312LC, ShireyLC, or any commercial tobacco variety according to standard tobacco breeding techniques known in the art.

All foregoing mentioned specific varieties of dark air-cured, Burley, Maryland, dark fire-cured, or Oriental type are listed only for exemplary purposes. Any additional dark air-cured, Burley, Maryland, dark fire-cured, Oriental varieties are also contemplated in the present application.

Also provided are populations of tobacco plants described. In an aspect, a population of tobacco plants has a planting density of between about 5,000 and about 8000, between about 5,000 and about 7,600, between about 5,000 and about 7,200, between about 5,000 and about 6,800, between about 5,000 and about 6,400, between about 5,000 and about 6,000, between about 5,000 and about 5,600, between about 5,000 and about 5,200, between about 5,200 and about 8,000, between about 5,600 and about 8,000, between about 6,000 and about 8,000, between about 6,400 and about 8,000, between about 6,800 and about 8,000, between about 7,200 and about 8,000, or between about 7,600 and about 8,000 plants per acre. In another aspect, a population of tobacco plants is in a soil type with low to medium fertility.

Also provided are containers of seeds from tobacco plants described. A container of tobacco seeds of the present disclosure may contain any number, weight, or volume of seeds. For example, a container can contain at least, or greater than, about 100, 200, 300, 400, 500, 600, 700, 800, 900, 1000, 1500, 2000, 2500, 3000, 3500, 4000 or more seeds. Alternatively, the container can contain at least, or greater than, about 1 ounce, 5 ounces, 10 ounces, 1 pound, 2 pounds, 3 pounds, 4 pounds, 5 pounds or more seeds, or at least 50,100,200, 300, 400, 500, 600, 700, 800, 900, 1000, 1500, 2000, 2500, 3000, 3500, 4000 grams. Containers of tobacco seeds may be any container available in the art. By way of non-limiting example, a container may be a box, a bag, a packet, a pouch, a tape roll, a tube, or a bottle.

Also provided is cured tobacco material made from a low-alkaloid or low-nicotine tobacco plant described. Further provided is cured tobacco material made from a tobacco plant described with higher levels of total alkaloid or nicotine.

"Curing" is the aging process that reduces moisture and brings about the destruction of chlorophyll giving tobacco leaves a golden color and by which starch is converted to sugar. Cured tobacco therefore has a higher reducing sugar content and a lower starch content compared to harvested green leaf. In an aspect, green leaf tobacco provided can be cured using conventional means, e.g., flue-cured, barn-cured, fire-cured, air-cured or sun-cured. See, for example, Tso (1999, Chapter 1 in Tobacco, Production, Chemistry and Technology, Davis & Nielsen, eds., Blackwell Publishing, Oxford) for a description of different types of curing methods. Cured tobacco is usually aged in a wooden drum (e.g., a hogshead) or cardboard cartons in compressed conditions for several years (e.g., two to five years), at a moisture content ranging from 10% to about 25%. See, U.S. Pat. Nos. 4,516,590 and 5,372,149. Cured and aged tobacco then can be further processed. Further processing includes conditioning the tobacco under vacuum with or without the introduction of steam at various temperatures, pasteurization, and fermentation. Fermentation typically is characterized by high initial moisture content, heat generation, and a 10 to 20% loss of dry weight. See, e.g., U.S. Pat. Nos. 4,528,993, 4,660,577, 4,848,373, 5,372,149; U.S. Publication No. 2005/0178398; and Tso (1999, Chapter 1 in Tobacco, Production, Chemistry and Technology, Davis & Nielsen, eds., Blackwell Publishing, Oxford). Cure, aged, and fermented tobacco can be further processed (e.g., cut, shredded, expanded, or blended). See, for example, U.S. Pat. Nos. 4,528,993; 4,660,577; and 4,987,907. In an aspect, the cured tobacco material of the present disclosure is sun-cured. In another aspect, the cured tobacco material of the present disclosure is flue-cured, air-cured, or fire-cured.

Tobacco material obtained from the tobacco lines, varieties or hybrids of the present disclosure can be used to make tobacco products. As used herein, "tobacco product" is defined as any product made or derived from tobacco that is intended for human use or consumption.

Tobacco products provided include, without limitation, cigarette products (e.g., cigarettes and bidi cigarettes), cigar products (e.g., cigar wrapping tobacco and cigarillos), pipe tobacco products, products derived from tobacco, tobacco-derived nicotine products, smokeless tobacco products (e.g., moist snuff, dry snuff, and chewing tobacco), films, chewables, tabs, shaped parts, gels, consumable units, insoluble matrices, hollow shapes, reconstituted tobacco, expanded tobacco, and the like. See, e.g., U.S. Patent Publication No. US 2006/0191548.

As used herein, "cigarette" refers a tobacco product having a "rod" and "filler". The cigarette "rod" includes the cigarette paper, filter, plug wrap (used to contain filtration materials), tipping paper that holds the cigarette paper (including the filler) to the filter, and all glues that hold these components together. The "filler" includes (1) all tobaccos, including but not limited to reconstituted and expanded tobacco, (2) non-tobacco substitutes (including but not limited to herbs, non-tobacco plant materials and other spices that may accompany tobaccos rolled within the cigarette paper), (3) casings, (4) flavorings, and (5) all other additives (that are mixed into tobaccos and substitutes and rolled into the cigarette).

As used herein, "reconstituted tobacco" refers to a part of tobacco filler made from tobacco dust and other tobacco scrap material, processed into sheet form and cut into strips to resemble tobacco. In addition to the cost savings, reconstituted tobacco is very important for its contribution to cigarette taste from processing flavor development using reactions between ammonia and sugars.

As used herein, "expanded tobacco" refers to a part of tobacco filler which is processed through expansion of suitable gases so that the tobacco is "puffed" resulting in reduced density and greater filling capacity. It reduces the weight of tobacco used in cigarettes.

Tobacco products derived from plants of the present disclosure also include cigarettes and other smoking articles, particularly those smoking articles including filter elements, where the rod of smokable material includes cured tobacco within a tobacco blend. In an aspect, a tobacco product of the present disclosure is selected from the group consisting of a cigarillo, a non-ventilated recess filter cigarette, a vented recess filter cigarette, a cigar, snuff, pipe tobacco, cigar tobacco, cigarette tobacco, chewing tobacco, leaf tobacco, hookah tobacco, shredded tobacco, and cut tobacco. In another aspect, a tobacco product of the present disclosure is a smokeless tobacco product. Smokeless tobacco products are not combusted and include, but not limited to, chewing tobacco, moist smokeless tobacco, snus, and dry snuff. Chewing tobacco is coarsely divided tobacco leaf that is typically packaged in a large pouch-like package and used in a plug or twist. Moist smokeless tobacco is a moist, more finely divided tobacco that is provided in loose form or in pouch form and is typically packaged in round cans and used as a pinch or in a pouch placed between an adult tobacco consumer's cheek and gum. Snus is a heat treated smokeless tobacco. Dry snuff is finely ground tobacco that is placed in the mouth or used nasally. In a further aspect, a tobacco product of the present disclosure is selected from the group consisting of loose leaf chewing tobacco, plug chewing tobacco, moist snuff, and nasal snuff. In yet another aspect, a tobacco product of the present disclosure is selected from the group consisting of an electronically heated cigarette, an e-cigarette, an electronic vaporing device.

In an aspect, a tobacco product of the present disclosure can be a blended tobacco product. In one aspect, a blended tobacco product comprises cured tobacco materials. In an aspect, a cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in a tobacco blend by weight. In one aspect, a cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in a tobacco blend by volume.

In another aspect, a tobacco product of the present disclosure can be a low nicotine tobacco product. In a further aspect, a tobacco product of the present disclosure may comprise nornicotine at a level of less than about 3 mg/g. For example, the nornicotine content in such a product can be about 3.0 mg/g, 2.5 mg/g, 2.0 mg/g, 1.5 mg/g, 1.0 mg/g, 750 μg/g, 500 pg/g, 250 pg/g, 100 pg/g, 75 pg/g, 50 pg/g, 25 pg/g, 10 pg/g, 7.0 pg/g, 5.0 pg/g, 4.0 pg/g, 2.0 pg/g, 1.0 pg/g, 0.5 pg/g, 0.4 pg/g, 0.2 pg/g, 0.1 pg/g, 0.05 pg/g, 0.01 pg/g, or undetectable.

In an aspect, cured tobacco material or tobacco products provided comprise an average nicotine or total alkaloid level selected from the group consisting of about 0.01%, 0.02%, 0.05%, 0.75%, 0.1%, 0.15%, 0.2%, 0.3%, 0.35%, 0.4%, 0.5%, 0.6%, 0.7%, 0.8%, 0.9%, 1%, 1.1%, 1.2%, 1.3%, 1.4%, 1.5%, 1.6%, 1.7%, 1.8%, 1.9%, 2%, 2.1%, 2.2%, 2.3%, 2.4%, 2.5%, 2.6%, 2.7%, 2.8%, 2.9%, 3%, 3.1%, 3.2%, 3.3%, 3.4%, 3.5%, 3.6%, 3.7%, 3.8%, 3.9%, 4%, 5%, 6%, 7%, 8%, and 9% on a dry weight basis. In another aspect, cured tobacco material or tobacco products provided comprise an average nicotine or total alkaloid level selected from the group consisting of about between 0.01% and 0.02%, between 0.02% and 0.05%, between 0.05% and 0.75%, between 0.75% and 0.1%, between 0.1% and 0.15%, between 0.15% and 0.2%, between 0.2% and 0.3%, between 0.3% and 0.35%, between 0.35% and 0.4%, between 0.4% and 0.5%, between 0.5% and 0.6%, between 0.6% and 0.7%, between 0.7% and 0.8%, between 0.8% and 0.9%, between 0.9% and 1%, between 1% and 1.1%, between 1.1% and 1.2%, between 1.2% and 1.3%, between 1.3% and 1.4%, between 1.4% and 1.5%, between 1.5% and 1.6%, between 1.6% and 1.7%, between 1.7% and 1.8%, between 1.8% and 1.9%, between 1.9% and 2%, between 2% and 2.1%, between 2.1% and 2.2%, between 2.2% and 2.3%, between 2.3% and 2.4%, between 2.4% and 2.5%, between 2.5% and 2.6%, between 2.6% and 2.7%, between 2.7% and 2.8%, between 2.8% and 2.9%, between 2.9% and 3%, between 3% and 3.1%, between 3.1% and 3.2%, between 3.2% and 3.3%, between 3.3% and 3.4%, between 3.4% and 3.5%, and between 3.5% and 3.6% on a dry weight basis. In a further aspect, cured tobacco material or tobacco products provided comprise an average nicotine or total alkaloid level selected from the group consisting of about between 0.01% and 0.1%, between 0.02% and 0.2%, between 0.03% and 0.3%, between 0.04% and 0.4%, between 0.05% and 0.5%, between 0.75% and 1%, between 0.1% and 1.5%, between 0.15% and 2%, between 0.2% and 3%, and between 0.3% and 3.5% on a dry weight basis.

The present disclosure further provides a method manufacturing a tobacco product comprising tobacco material from tobacco plants disclosed. In an aspect, methods comprise conditioning aged tobacco material made from tobacco plants to increase its moisture content from between about 12.5% and about 13.5% to about 21%, blending the conditioned tobacco material to produce a desirable blend. In an aspect, the method of manufacturing a tobacco product further comprises casing or flavoring the blend. Generally, during the casing process, casing or sauce materials are added to blends to enhance their quality by balancing the chemical composition and to develop certain desired flavor characteristics. Further details for the casing process can be found in Tobacco Production, Chemistry and Technology, Edited by L. Davis and M. Nielsen, Blackwell Science, 1999.

Tobacco material provided can be also processed using methods including, but not limited to, heat treatment (e.g., cooking, toasting), flavoring, enzyme treatment, expansion and/or curing. Both fermented and non-fermented tobaccos can be processed using these techniques. Examples of suitable processed tobaccos include dark air-cured, dark fire cured, burley, flue cured, and cigar filler or wrapper, as well as the products from the whole leaf stemming operation. In an aspect, tobacco fibers include up to 70% dark tobacco on a fresh weight basis. For example, tobacco can be conditioned by heating, sweating and/or pasteurizing steps as described in U.S. Publication Nos. 2004/0118422 or 2005/0178398.

Tobacco material provided can be subject to fermentation. Fermenting typically is characterized by high initial moisture content, heat generation, and a 10 to 20% loss of dry weight. See, e.g., U.S. Pat. Nos. 4,528,993; 4,660,577; 4,848,373; and 5,372,149. In addition to modifying the aroma of the leaf, fermentation can change either or both the color and texture of a leaf. Also during the fermentation process, evolution gases can be produced, oxygen can be taken up, the pH can change, and the amount of water retained can change. See, for example, U.S. Publication No. 2005/0178398 and Tso (1999, Chapter 1 in Tobacco, Production, Chemistry and Technology, Davis & Nielsen, eds., Blackwell Publishing, Oxford). Cured, or cured and fermented tobacco can be further processed (e.g., cut, expanded, blended, milled or comminuted) prior to incorporation into the oral product. The tobacco, in some cases, is long cut fermented cured moist tobacco having an oven volatiles content of between 48 and 50 weight percent prior to mixing with the copolymer and optionally flavorants and other additives.

In an aspect, tobacco material provided can be processed to a desired size. In an aspect, tobacco fibers can be processed to have an average fiber size of less than 200 micrometers. In an aspect, tobacco fibers are between 75 and 125 micrometers. In another aspect, tobacco fibers are processed to have a size of 75 micrometers or less. In an aspect, tobacco fibers include long cut tobacco, which can be cut or shredded into widths of about 10 cuts/inch up to about 110 cuts/inch and lengths of about 0.1 inches up to about 1 inch. Double cut tobacco fibers can have a range of particle sizes such that about 70% of the double cut tobacco fibers falls between the mesh sizes of −20 mesh and 80 mesh.

Tobacco material provided can be processed to have a total oven volatiles content of about 10% by weight or greater; about 20% by weight or greater; about 40% by weight or greater; about 15% by weight to about 25% by weight; about 20% by weight to about 30% by weight; about 30% by weight to about 50% by weight; about 45% by weight to about 65% by weight; or about 50% by weight to about 60% by weight. Those of skill in the art will appreciate that "moist" tobacco typically refers to tobacco that has an oven volatiles content of between about 40% by weight and about 60% by weight (e.g., about 45% by weight to about 55% by weight, or about 50% by weight). As used herein, "oven volatiles" are determined by calculating the percentage of weight loss for a sample after drying the sample in a pre-warmed forced draft oven at 110° C. for 3.25 hours. The oral product can have a different overall oven volatiles content than the oven volatiles content of the tobacco fibers used to make the oral product. The processing steps described can reduce or increase the oven volatiles content.

The present disclosure also provides methods for breeding tobacco lines, cultivars, or varieties comprising a desirable level of total alkaloid or nicotine, e.g., low nicotine or nicotine free. Breeding can be carried out via any known procedures. DNA fingerprinting, SNP mapping, haplotype mapping or similar technologies may be used in a marker-assisted selection (MAS) breeding program to transfer or breed a desirable trait or allele into a tobacco plant. For example, a breeder can create segregating populations in a $F_2$ or backcross generation using F1 hybrid plants or further crossing the F1 hybrid plants with other donor plants with an agronomically desirable genotype. Plants in the $F_2$ or back-cross generations can be screened for a desired agronomic trait or a desirable chemical profile using one of the techniques known in the art or listed herein. Depending on the expected inheritance pattern or the MAS technology used, self-pollination of selected plants before each cycle of backcrossing to aid identification of the desired individual plants can be performed. Backcrossing or other breeding procedure can be repeated until the desired phenotype of the recurrent parent is recovered. A recurrent parent in the present disclosure can be a flue-cured variety, a Burley variety, a dark air-cured variety, a dark fire-cured variety, or an Oriental variety. Other breeding techniques can be found, for example, in Wernsman, E. A., and Rufty, R. C. 1987. Chapter Seventeen. Tobacco. Pages 669-698 In: Cultivar Development. Crop Species. W. H. Fehr (ed.), MacMillan Publishing Go., Inc., New York, N.Y., incorporated herein by reference in their entirety.

Results of a plant breeding program using the tobacco plants described includes useful lines, cultivars, varieties, progeny, inbreds, and hybrids of the present disclosure. As used herein, the term "variety" refers to a population of plants that share constant characteristics which separate them from other plants of the same species. A variety is often, although not always, sold commercially. While possessing one or more distinctive traits, a variety is further characterized by a very small overall variation between individuals within that variety. A "pure line" variety may be created by several generations of self-pollination and selection, or vegetative propagation from a single parent using tissue or cell culture techniques. A variety can be essentially derived from another line or variety. As defined by the International Convention for the Protection of New Varieties of Plants (Dec. 2, 1961, as revised at Geneva on Nov. 10, 1972; on Oct. 23, 1978; and on Mar. 19, 1991), a variety is "essentially derived" from an initial variety if: a) it is predominantly derived from the initial variety, or from a variety that is predominantly derived from the initial variety, while retaining the expression of the essential characteristics that result from the genotype or combination of genotypes of the initial variety; b) it is clearly distinguishable from the initial variety; and c) except for the differences which result from the act of derivation, it conforms to the initial variety in the expression of the essential characteristics that result from the genotype or combination of genotypes of the initial variety. Essentially derived varieties can be obtained, for example, by the selection of a natural or induced mutant, a somaclonal variant, a variant individual from plants of the initial variety, backcrossing, or transformation. A first tobacco variety and a second tobacco variety from which the first variety is essentially derived, are considered as having essentially identical genetic background. A "line" as distinguished from a variety most often denotes a group of plants used non-commercially, for example in plant research. A line typically displays little overall variation between individuals for one or more traits of interest, although there may be some variation between individuals for other traits.

In a further aspect, tobacco parts provided include, but are not limited to, a leaf, a stem, a root, a seed, a flower, pollen, an anther, an ovule, a pedicel, a fruit, a meristem, a cotyledon, a hypocotyl, a pod, an embryo, endosperm, an explant, a callus, a tissue culture, a shoot, a cell, and a protoplast. In an aspect, tobacco part provided does not include seed. In an aspect, this disclosure provides tobacco plant cells, tissues, and organs that are not reproductive material and do not mediate the natural reproduction of the plant. In another aspect, this disclosure also provides tobacco plant cells, tissues, and organs that are reproductive material and mediate the natural reproduction of the plant. In another aspect, this disclosure provides tobacco plant cells, tissues, and organs that cannot maintain themselves via photosynthesis. In another aspect, this disclosure provides somatic tobacco plant cells. Somatic cells, contrary to germline cells, do not mediate plant reproduction.

The provided cells, tissues and organs may be from seed, fruit, leaf, cotyledon, hypocotyl, meristem, embryos, endosperm, root, shoot, stem, pod, flower, inflorescence, stalk, pedicel, style, stigma, receptacle, petal, sepal, pollen, anther, filament, ovary, ovule, pericarp, phloem, vascular tissue. In another aspect, this disclosure provides a tobacco plant chloroplast. In a further aspect, this disclosure provides epidermal cells, stomata cell, leaf or root hairs, a storage root, or a tuber. In another aspect, this disclosure provides a tobacco protoplast.

Skilled artisans understand that tobacco plants naturally reproduce via seeds, not via asexual reproduction or vegetative propagation. In an aspect, this disclosure provides tobacco endosperm. In another aspect, this disclosure provides tobacco endosperm cells. In a further aspect, this disclosure provides a male or female sterile tobacco plant, which cannot reproduce without human intervention. Skilled artisans further understand that cured tobacco does not constitute a living organism and is not capable of growth or reproduction.

The following are exemplary embodiments of the present disclosure.

Embodiment 1. A tobacco plant, or part thereof, comprising a first genetic modification suppressing one or more genes from a NIC1b locus, a NIC2 locus, or both, and further comprising a second genetic modification increasing nicotine to nornicotine conversion.

Embodiment 2. The tobacco plant, or part thereof, of Embodiment 1, wherein said first genetic modification comprises a nic1b mutant allele.

Embodiment 3. The tobacco plant, or part thereof, of Embodiment 2, wherein said nic1b mutant allele is derived from a Cuban cigar tobacco variety, Low-Alkaloid Burley 21 (LA BU21), Low Intermediate Burley 21 (LI BU21), Low-Alkaloid Flue-Cured 53 (LA FC53), Low-Nicotine KY171 (LN KY171), or a variety derived therefrom.

Embodiment 4. The tobacco plant, or part thereof, of Embodiment 1, wherein said first genetic modification comprises a transgene or mutation decreasing the expression or activity of one or more ethylene-response factor (ERF) genes from a NIC1b locus.

Embodiment 5. The tobacco plant, or part thereof, of Embodiment 4, wherein said first genetic modification comprises a transgene targeting one or more genes selected from the group consisting of ERF101, ERF110, ERFnew, ERF199, ERF19, ERF130, ERF16, ERF29, ERF210, and ERF91L2.

Embodiment 6. The tobacco plant, or part thereof, of Embodiment 1, wherein said first genetic modification comprises a transgene or mutation decreasing the expression or activity of one or more non-ERF genes from a NIC1b locus.

Embodiment 7. The tobacco plant, or part thereof, of Embodiment 1, wherein said first genetic modification comprises a transgene or mutation increasing the expression or activity of one or more ethylene-response factor (ERF) genes from a NIC1b locus.

Embodiment 8. The tobacco plant, or part thereof, of Embodiment 1, wherein said first genetic modification comprises a transgene or mutation decreasing the expression or activity of one or more non-ERF genes from a NIC1b locus.

Embodiment 9. The tobacco plant, or part thereof, of Embodiment 1, wherein said first genetic modification comprises a nic2 mutant allele.

Embodiment 10. The tobacco plant, or part thereof, of Embodiment 9, wherein said nic2 mutant allele is derived from a Cuban cigar tobacco variety, Low-Alkaloid Burley 21 (LA BU21), High Intermediate Burley 21 (HI BU21), Low-Alkaloid Flue-Cured 53 (LA FC53), Low-Nicotine KY171 (LN KY171), or a variety derived therefrom.

Embodiment 11. The tobacco plant, or part thereof, of Embodiment 1, wherein said first genetic modification comprises a transgene or mutation decreasing the expression or activity of one or more ethylene-response factor (ERF) genes from a NIC2 locus.

Embodiment 12. The tobacco plant, or part thereof, of Embodiment 11, wherein said first genetic modification comprises a transgene targeting one or more genes selected from the group consisting of ERF189, ERF115, ERF221, ERF104, ERF179, ERF17, and ERF168.

Embodiment 13. The tobacco plant, or part thereof, of any one of Embodiments 1 to 12, wherein said second genetic modification overexpressing a nicotine demethylase.

Embodiment 14. The tobacco plant, or part thereof, of any one of Embodiment 13, wherein said second genetic modification comprises a transgene encoding said nicotine demethylase.

Embodiment 15. The tobacco plant, or part thereof, of any one of Embodiment 13, wherein said nicotine demethylase is from a plant of the *Nicotiana* genus.

Embodiment 16. The tobacco plant, or part thereof, of any one of Embodiment 13, wherein said nicotine demethylase comprises a non-natural, mutated, or engineered amino acid sequence.

Embodiment 17. The tobacco plant, or part thereof, of any one of Embodiment 13, wherein said nicotine demethylase comprises a natural or tobacco-native amino acid sequence.

Embodiment 18. The tobacco plant, or part thereof, of any one of Embodiments 1 to 12, wherein said second genetic modification comprises a transgene encoding one or more of CYP82E4, CYP82E5, and CYP85E10 polypeptides.

Embodiment 19. The tobacco plant, or part thereof, of any one of Embodiments 1 to 12, wherein said second genetic modification comprises a genome edit increasing the expression or activity of one or more of CYP82E4, CYP82E5, and CYP85E10 polypeptides.

Embodiment 20. The tobacco plant, or part thereof, of Embodiments 18 or 19, wherein said second genetic modification increases the expression or activity of CYP82E4v2, or comprises a transgene encoding CYP82E4v2.

Embodiment 21. The tobacco plant, or part thereof, of any one of Embodiments 1 to 20, wherein said tobacco plant further comprises a third genetic modification increasing the level of one or more antioxidants compared to a control plant lacking said third genetic modification.

Embodiment 22. The tobacco plant, or part thereof, of Embodiment 21, wherein said third genetic modification comprises a transgene encoding or targeting an antioxidant biosynthetic enzyme, a regulatory transcription factor of an antioxidant, an antioxidant transporter, an antioxidant metabolic enzyme, or a combination thereof.

Embodiment 23. The tobacco plant, or part thereof, of Embodiment 21, wherein said third genetic modification comprises a modification of one or more endogenous genes encoding an antioxidant biosynthetic enzyme, a regulatory transcription factor of an antioxidant, an antioxidant transporter, an antioxidant metabolic enzyme, or a combination thereof.

Embodiment 24. The tobacco plant, or part thereof, of Embodiment 21, wherein said one or more antioxidants are selected from the group consisting of anthocyanidin, flavanone, flavanol, flavone, flavonol, isoflavone, hydroxybenzoic acid, hydroxycinnamic acid, ellagitannin, stibene, lignan, carotenoids, and glycyrrhzin.

Embodiment 25. The tobacco plant, or part thereof, of Embodiment 21, wherein said one or more antioxidants are selected from the group consisting of Delphinidin, Cyanidin, Procyanidin, Prodelphinidin, Hesperetin, Naringenin, Catechin, Epicatechin, Apigenin, Luteonin, Quercetin, Myricetin, Rutin, Genistein, Daidzein, Gallic acid, Vanillic acid, Protocatechuic acid, Ferunic acid, Cinnamic acid, Coumeric acid, Chlorogenic acid, Coffeic acid, ferulic acid, Sanguiin, Resveratrol, Sesamin, Caretonoids, and Vitamin C.

Embodiment 26. The tobacco plant, or part thereof, of Embodiment 21, wherein said third genetic modification comprises a transgene encoding one or more polypeptides selected from the group consisting of AtPAP1, Ntmyb3A, Ntmyb3B, Ntmyb3C, NtJAF13, StAN1, NtAN1, and NtAN2.

Embodiment 27. A tobacco plant, or part thereof, comprising a first genetic modification increasing the nicotine to nornicotine conversion and further comprising a second genetic modification increasing the level of one or more antioxidants.

Embodiment 28. The tobacco plant, or part thereof, of Embodiment 27, further comprising a third genetic modification reducing nicotine in said tobacco plant.

Embodiment 29. The tobacco plant, or part thereof, of Embodiment 28, wherein said third genetic modification comprises a nic1b mutant allele, a nic2 mutant allele, or both.

Embodiment 30. The tobacco plant, or part thereof, of Embodiment 29, wherein said nic1b mutant allele is derived from a Cuban cigar tobacco variety, Low-Alkaloid Burley 21 (LA BU21), Low Intermediate Burley 21 (LI BU21), Low-Alkaloid Flue-Cured 53 (LA FC53), Low-Nicotine KY171 (LN KY171), or a variety derived therefrom.

Embodiment 31. The tobacco plant, or part thereof, of Embodiment 28, wherein said third genetic modification comprises a transgene or mutation decreasing the expression or activity of one or more ethylene-response factor (ERF) genes from a NIC1b locus.

Embodiment 32. The tobacco plant, or part thereof, of Embodiment 28, wherein said third genetic modification comprises a transgene targeting one or more genes selected from the group consisting of ERF101, ERF110, ERFnew, ERF199, ERF19, ERF130, ERF16, ERF29, ERF210, and ERF91L2.

Embodiment 33. The tobacco plant, or part thereof, of Embodiment 28, wherein said third genetic modification comprises a transgene or mutation decreasing the expression or activity of one or more non-ERF genes from a NIC1b locus.

Embodiment 34. The tobacco plant, or part thereof, of Embodiment 28, wherein said third genetic modification comprises a transgene or mutation increasing the expression or activity of one or more ethylene-response factor (ERF) genes from a NIC1b locus.

Embodiment 35. The tobacco plant, or part thereof, of Embodiment 28, wherein said third genetic modification comprises a transgene or mutation increasing the expression or activity of one or more non-ERF genes from a NIC1b locus.

Embodiment 36. The tobacco plant, or part thereof, of Embodiment 29, wherein said nic2 mutant allele is derived from a Cuban cigar tobacco variety, Low-Alkaloid Burley 21 (LA BU21), High Intermediate Burley 21 (HI BU21), Low-Alkaloid Flue-Cured 53 (LA FC53), Low-Nicotine KY171 (LN KY171), or a variety derived therefrom.

Embodiment 37. The tobacco plant, or part thereof, of Embodiment 28, wherein said third genetic modification comprises a transgene or mutation decreasing the expression or activity of one or more ethylene-response factor (ERF) genes from a NIC2 locus.

Embodiment 38. The tobacco plant, or part thereof, of Embodiment 37, wherein said third genetic modification comprises a transgene targeting one or more genes selected from the group consisting of ERF189, ERF115, ERF221, ERF104, ERF179, ERF17, and ERF168.

Embodiment 39. The tobacco plant, or part thereof, of any one of Embodiments 28 to 38, wherein said second genetic modification comprises a transgene encoding a nicotine demethylase.

Embodiment 40. The tobacco plant, or part thereof, of any one of Embodiment 39, wherein said nicotine demethylase is from a plant of the *Nicotiana* genus.

Embodiment 41. The tobacco plant, or part thereof, of any one of Embodiment 39, wherein said nicotine demethylase comprises a non-natural, mutated, or engineered amino acid sequence.

Embodiment 42. The tobacco plant, or part thereof, of any one of Embodiment 39, wherein said nicotine demethylase comprises a natural or tobacco-native amino acid sequence.

Embodiment 43. The tobacco plant, or part thereof, of any one of Embodiments 28 to 38, wherein said second genetic modification comprises a transgene encoding one or more of CYP82E4, CYP82E5, and CYP85E10 polypeptides.

Embodiment 44. The tobacco plant, or part thereof, of Embodiment 43, wherein said second genetic modification comprises a transgene encoding CYP82E4v2.

Embodiment 45. The tobacco plant, or part thereof, of any one of Embodiments 28 to 38, wherein said second genetic modification comprises a genome edit that increases the expression or activity of one or more of CYP82E4, CYP82E5, and CYP85E10 polypeptides.

Embodiment 46. The tobacco plant, or part thereof, of Embodiment 45, wherein said second genetic modification comprises a genome edit that increases the expression or activity of CYP82E4v2.

Embodiment 47. The tobacco plant, or part thereof, of any one of Embodiments 28 to 46, wherein said second genetic modification increases the level of one or more antioxidants and decreases the level of one or more TSNAs compared to a control plant lacking said second genetic modification.

Embodiment 48. The tobacco plant, or part thereof, of Embodiment 47, wherein said second genetic modification comprises a transgene encoding or targeting an antioxidant biosynthetic enzyme, a regulatory transcription factor of an antioxidant, an antioxidant transporter, an antioxidant metabolic enzyme, or a combination thereof.

Embodiment 49. The tobacco plant, or part thereof, of Embodiment 47, wherein said second genetic modification comprises a modification of one or more endogenous genes encoding an antioxidant biosynthetic enzyme, a regulatory transcription factor of an antioxidant, an antioxidant transporter, an antioxidant metabolic enzyme, or a combination thereof.

Embodiment 50. The tobacco plant, or part thereof, of Embodiment 47, wherein said one or more antioxidants are selected from the group consisting of anthocyanidin, flavanone, flavanol, flavone, flavonol, isoflavone, hydroxybenzoic acid, hydroxycinnamic acid, ellagitannin, stibene, lignan, carotenoids, and glycyrrhzin.

Embodiment 51. The tobacco plant, or part thereof, of Embodiment 47, wherein said one or more antioxidants are selected from the group consisting of Delphinidin, Cyanidin, Procyanidin, Prodelphinidin, Hesperetin, Naringenin, Catechin, Epicatechin, Apigenin, Luteonin, Quercetin, Myricetin, Rutin, Genistein, Daidzein, Gallic acid, Vanillic acid, Protocatechuic acid, Ferunic acid, Cinnamic acid, Coumeric acid, Chlorogenic acid, Coffeic acid, ferulic acid, Sanguiin, Resveratrol, Sesamin, Caretonoids, and Vitamin C.

Embodiment 52. The tobacco plant, or part thereof, of Embodiment 47, wherein said second genetic modification comprises a transgene encoding one or more polypeptides selected from the group consisting of AtPAP1, Ntmyb3A, Ntmyb3B, Ntmyb3C, NtJAF13, StAN1, NtAN1, and NtAN2.

Embodiment 53. The tobacco plant, or part thereof, of any one of the preceding Embodiments, wherein said plant is capable of producing a leaf having a USDA grade index value of at least about 65%, at least about 70%, at least about 75%, at least about 80%, at least about 85%, at least about 90%, at least about 95%, or at least about 98% of the USDA grade index value of a leaf from a control plant grown and processed under similar conditions, and wherein said control plant shares an essentially identical genetic background with said tobacco plant except one or both of said genetic modifications.

Embodiment 54. The tobacco plant, or part thereof, of any one of the preceding Embodiments, wherein said plant is capable of producing a leaf exhibiting a USDA grade index value selected from the group consisting of 55 or more, 60 or more, 65 or more, 70 or more, 75 or more, 80 or more, 85 or more, 90 or more, and 95 or more.

Embodiment 55. The tobacco plant, or part thereof, of any one of the preceding Embodiments, wherein said plant is capable of producing a leaf comprising a nicotine level of below 1%, below 2%, below 5%, below 8%, below 10%, below 12%, below 15%, below 20%, below 25%, below 30%, below 40%, below 50%, below 60%, below 70%, or below 80% of the nicotine level of a control plant when grown in similar growth conditions, wherein said control plant shares an essentially identical genetic background with said tobacco plant except one or both of said genetic modifications.

Embodiment 56. The tobacco plant, or part thereof, of any one of the preceding Embodiments, wherein said plant is capable of producing a leaf comprising a nicotine level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05% dry weight.

Embodiment 57. The tobacco plant, or part thereof, of any one of the preceding Embodiments, wherein said plant is capable of producing a cured leaf comprising a total TSNA level of less than 2, less than 1.9, less than 1.8, less than 1.7, less than 1.6, less than 1.5, less than 1.4, less than 1.3, less than 1.2, less than 1.1, less than 1.0, less than 0.9, less than 0.8, less than 0.7, less than 0.6, less than 0.5, less than 0.4, less than 0.3, less than 0.2, less than 0.15, less than 0.1, or less than 0.05 ppm.

Embodiment 58. The tobacco plant, or part thereof, of any one of the preceding Embodiments, wherein said plant is capable of producing a cured leaf comprising a total TSNA level of between 2 and 0.05, between 1.9 and 0.05, between 1.8 and 0.05, between 1.7 and 0.05, between 1.6 and 0.05, between 1.5 and 0.05, between 1.4 and 0.05, between 1.3 and 0.05, between 1.2 and 0.05, between 1.1 and 0.05, between 1.0 and 0.05, between 0.9 and 0.05, between 0.8 and 0.05, between 0.7 and 0.05, between 0.6 and 0.05, between 0.5 and 0.05, between 0.4 and 0.05, between 0.3 and 0.05, between 0.2 and 0.05, between 0.15 and 0.05, or between 0.1 and 0.05 ppm.

Embodiment 59. The tobacco plant, or part thereof, of any one of the preceding Embodiments, wherein said plant is capable of producing a cured leaf comprising a total NNN level of less than 2, less than 1.9, less than 1.8, less than 1.7, less than 1.6, less than 1.5, less than 1.4, less than 1.3, less than 1.2, less than 1.1, less than 1.0, less than 0.9, less than 0.8, less than 0.7, less than 0.6, less than 0.5, less than 0.4, less than 0.3, less than 0.2, less than 0.15, less than 0.1, or less than 0.05 ppm.

Embodiment 60. The tobacco plant, or part thereof, of any one of the preceding Embodiments, wherein said plant is capable of producing a cured leaf comprising a total NNN level of between 2 and 0.05, between 1.9 and 0.05, between 1.8 and 0.05, between 1.7 and 0.05, between 1.6 and 0.05, between 1.5 and 0.05, between 1.4 and 0.05, between 1.3 and 0.05, between 1.2 and 0.05, between 1.1 and 0.05, between 1.0 and 0.05, between 0.9 and 0.05, between 0.8 and 0.05, between 0.7 and 0.05, between 0.6 and 0.05, between 0.5 and 0.05, between 0.4 and 0.05, between 0.3 and 0.05, between 0.2 and 0.05, between 0.15 and 0.05, or between 0.1 and 0.05 ppm.

Embodiment 61. The tobacco plant, or part thereof, of any one of the preceding Embodiments, wherein said plant is capable of producing a cured leaf comprising a total NNK level of less than 2, less than 1.9, less than 1.8, less than 1.7, less than 1.6, less than 1.5, less than 1.4, less than 1.3, less than 1.2, less than 1.1, less than 1.0, less than 0.9, less than 0.8, less than 0.7, less than 0.6, less than 0.5, less than 0.4, less than 0.3, less than 0.2, less than 0.15, less than 0.1, or less than 0.05 ppm.

Embodiment 62. The tobacco plant, or part thereof, of any one of the preceding Embodiments, wherein said plant is capable of producing a cured leaf comprising a total NNK level of between 2 and 0.05, between 1.9 and 0.05, between 1.8 and 0.05, between 1.7 and 0.05, between 1.6 and 0.05, between 1.5 and 0.05, between 1.4 and 0.05, between 1.3 and 0.05, between 1.2 and 0.05, between 1.1 and 0.05, between 1.0 and 0.05, between 0.9 and 0.05, between 0.8 and 0.05, between 0.7 and 0.05, between 0.6 and 0.05, between 0.5 and 0.05, between 0.4 and 0.05, between 0.3 and 0.05, between 0.2 and 0.05, between 0.15 and 0.05, or between 0.1 and 0.05 ppm.

Embodiment 63. A population of the tobacco plants of any one of Embodiments 28 to 62.

Embodiment 64. Cured tobacco material from the tobacco plant of any one of Embodiments 1 to 62.

Embodiment 65. The cured tobacco material of Embodiment 64, wherein said cured tobacco material is made by a curing process selected from the group consisting of flue curing, air curing, fire curing, and sun curing.

Embodiment 66. A tobacco blend comprising said cured tobacco material of Embodiment 64.

Embodiment 67. The tobacco blend of Embodiment 66, wherein said cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in said tobacco blend by weight.

Embodiment 68. The tobacco blend of Embodiment 66, wherein said cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in said tobacco blend by volume.

Embodiment 69. A tobacco product comprising the cured tobacco material of Embodiment 64.

Embodiment 70. The tobacco product of Embodiment 69, wherein said tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.

Embodiment 71. The tobacco product of Embodiment 69, wherein said tobacco product is a smokeless tobacco product.

Embodiment 72. The tobacco product of Embodiment 71, wherein said smokeless tobacco product is selected from the group consisting of loose leaf chewing tobacco, plug chewing tobacco, moist snuff, and nasal snuff.

Embodiment 73. A reconstituted tobacco comprising the cured tobacco material of Embodiment 64.

Having now generally described the disclosure, the same will be more readily understood through reference to the following examples that are provided by way of illustration, and are not intended to be limiting of the present disclosure, unless specified.

EXAMPLES

Example 1. Plant Transformation

Tobacco plants expressing a gene of interest are generated via *Agrobacterium*-mediated transformation. An expression vector, p45-2-7, is used as a backbone to generate multiple transformation vectors. p45-2-7 contains a CsVMV promoter, a NOS terminator, and a cassette comprising a kanamycin selection marker (NPT II) operably linked to an Actin2 promoter and a NOS terminator. Nucleic acid vectors comprising transgenes of interest are introduced into tobacco leaf discs via *Agrobacterium* transformation. See, for example, Mayo et al., 2006, *Nat Protoc.* 1:1105-11 and Horsch et al., 1985, Science 227:1229-1231.

High intermediate Burley 21 (HI BU21) or low intermediate Burley 21 (LI BU21) tobacco plants are grown in Magenta™ GA-7 boxes and leaf discs are cut and placed into Petri plates. *Agrobacterium tumefaciens* cells comprising a transformation vector are collected by centrifuging a 20 mL cell suspension in a 50 mL centrifuge tube at 3500 RPM for 10 minutes. The supernatant is removed and the

*Agrobacterium tumefaciens* cell pellet is re-suspended in 40 mL liquid re-suspension medium. A tobacco leaf, avoiding the midrib, is cut into eight 0.6 cm discs with a #15 razor blade and placed upside down in a Petri plate. A thin layer of Murashige & Skoog with B5 vitamin liquid re-suspension medium is added to the Petri plate and the leaf discs are poked uniformly with a fine point needle. About 25 mL of the *Agrobacterium tumefaciens* suspension is added to the Petri plate and the leaf discs are incubated in the suspension for 10 minutes.

Leaf discs are transferred to co-cultivation Petri plates (1/2 MS medium) and discs are placed upside down in contact with filter paper overlaid on the co-cultivation TOM medium (MS medium with 20 g/L sucrose; 1 mg/L indole-3-acetic acid; and 2.5 mg/L 6-benzyl aminopurine (BAP)). The Petri plate is sealed with parafilm prior to incubation in dim light (60-80 mE/ms) with 18 hours on, 6 hours off photoperiods at 24 degrees Celsius for three days. After incubation, leaf discs are transferred to regeneration/selection TOM K medium Petri plates (TOM medium plus 300 mg/L kanamycin). Leaf discs are sub-cultured bi-weekly to fresh TOM K medium in dim light with 18 hours on, 6 hours off photoperiods at 24 degrees Celsius until shoots become excisable. Shoots regenerated from leaf disks are removed with forceps and inserted in MS basal medium with 100 mg/L kanamycin. Explants are placed on MS basal medium with 100 mg/L kanamycin are incubated at 24 degrees Celsius with 18 hours on, 6 hours off photoperiods with high intensity lighting (6080 mE/ms) to induce rooting.

When plantlets containing both shoots and roots grow large enough (e.g., reach approximately half the height of a Magenta™ GA-7 box), they are transferred to soil. Established seedlings are transferred to a greenhouse for further analysis and to set seed. Control plants are untransformed HI BU21 or LI BU21 plants, or HI BU21 or LI BU21 plants that have been transformed with an empty p45-2-7 vector.

Figure 2:
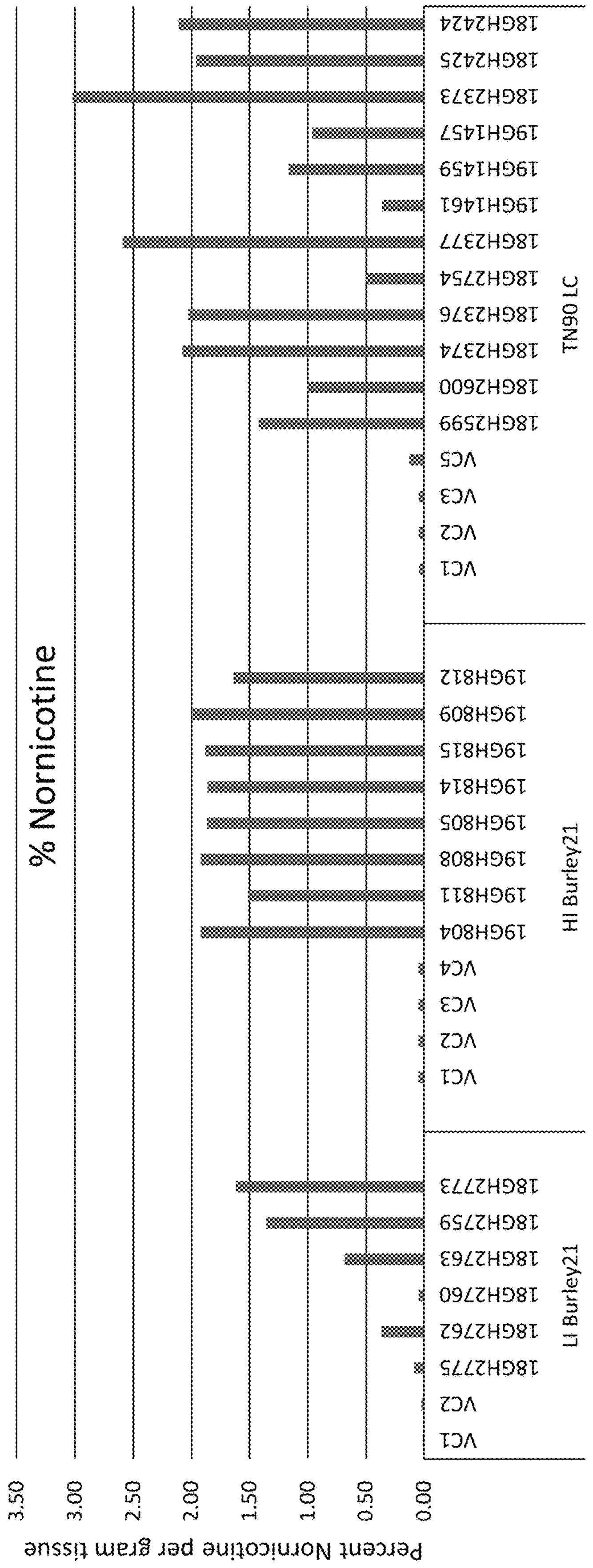
FIG. 2: Nornicotine levels in greenhouse-grown $T_0$ transgenic plants overexpressing nicotine demethylase CYP82E4v2.
Figure 3:
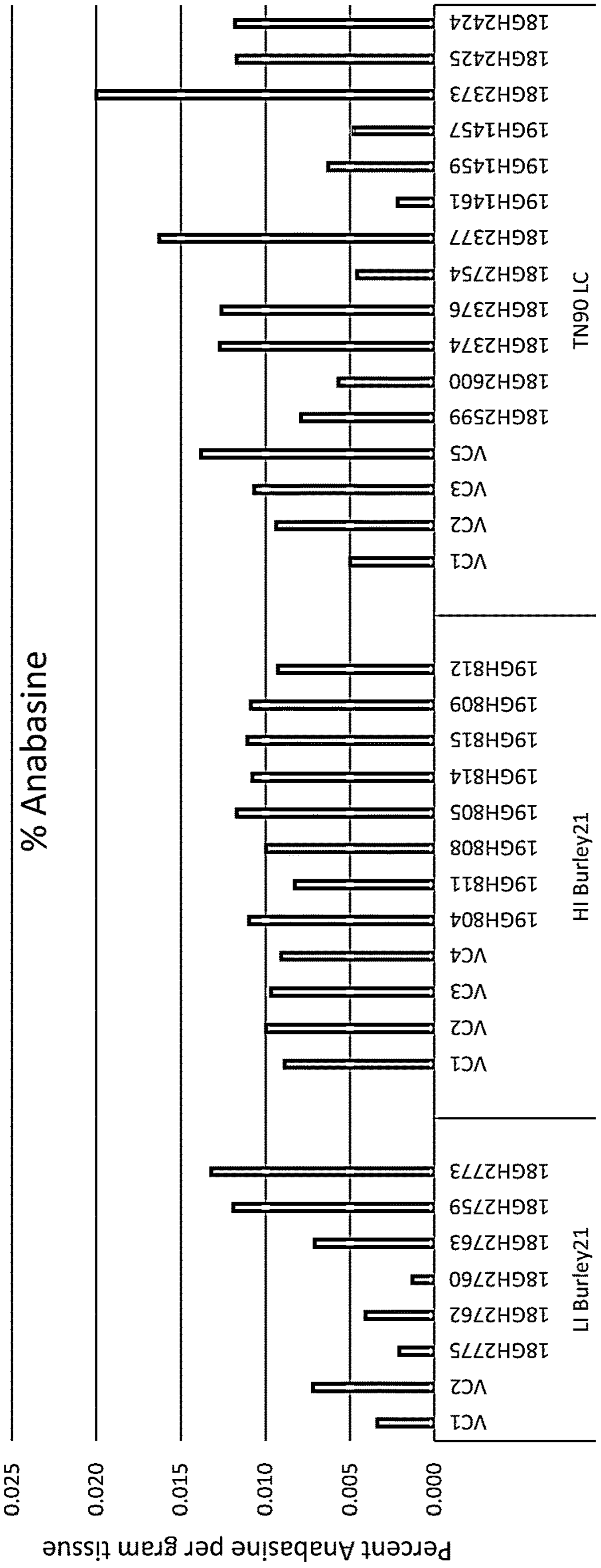
FIG. 3: Anabasine levels in greenhouse-grown $T_0$ transgenic plants overexpressing nicotine demethylase CYP82E4v2.
Figure 4:
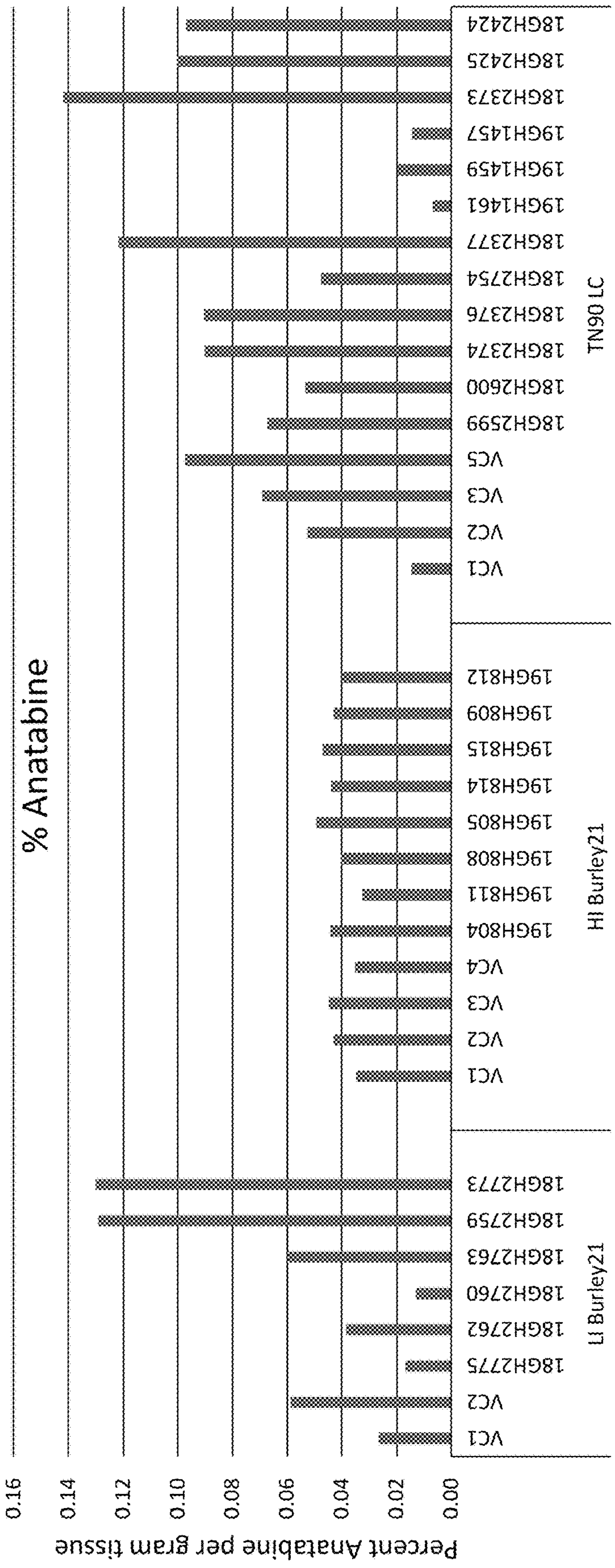
FIG. 4: Anatabine levels in greenhouse-grown $T_0$ transgenic plants overexpressing nicotine demethylase CYP82E4v2.
Figure 5:
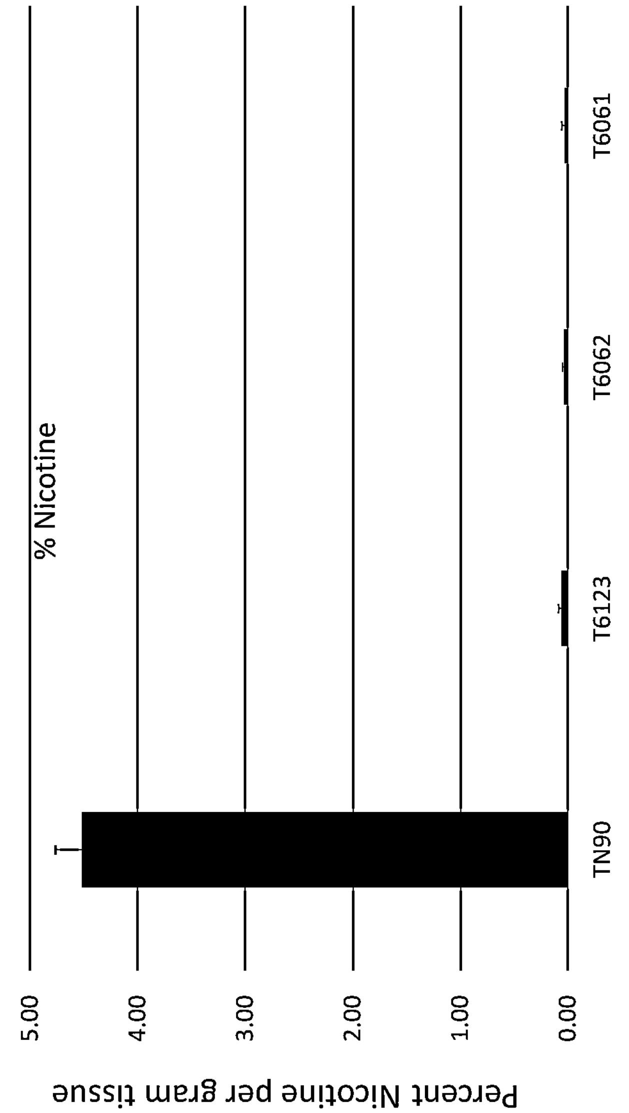
FIG. 5: Nicotine levels in field-grown $T_1$ transgenic plants overexpressing nicotine demethylase CYP82E4v2.
Figure 6:
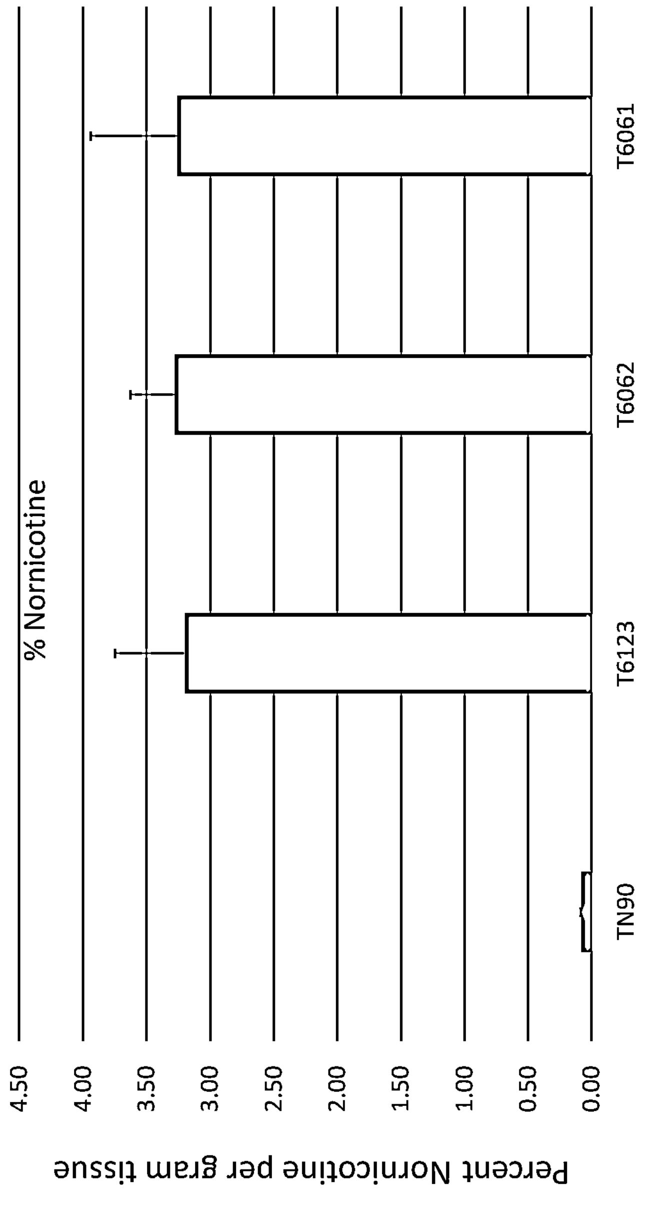
FIG. 6: Nornicotine levels in field-grown $T_1$ transgenic plants overexpressing nicotine demethylase CYP82E4v2.
Figure 7:
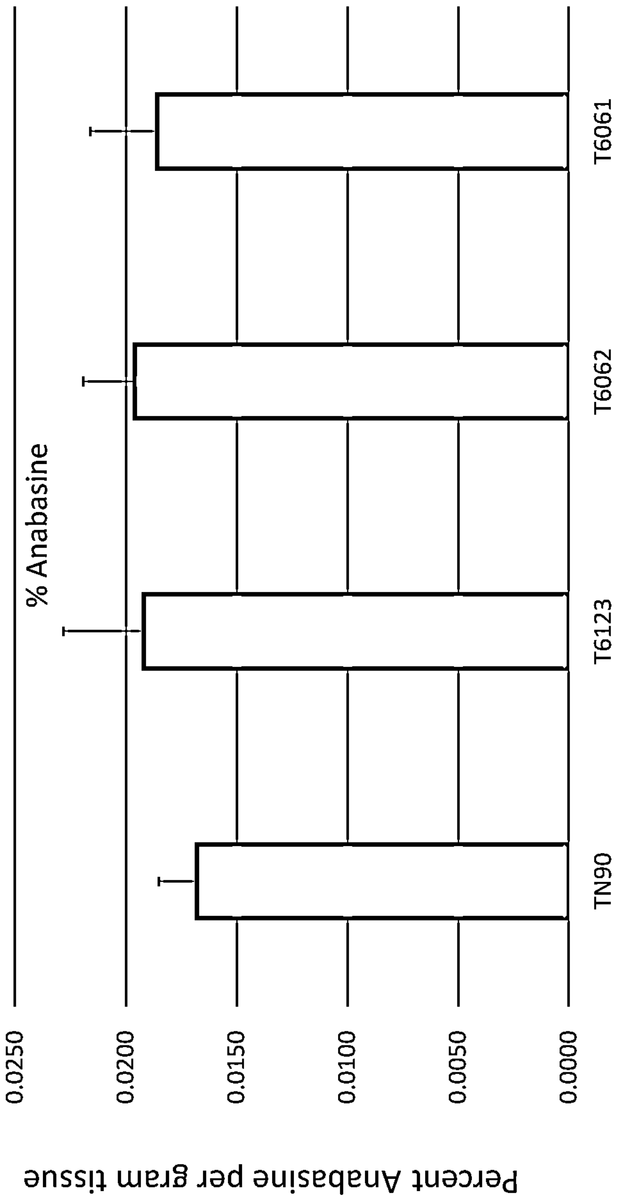
FIG. 7: Anabasine levels in field-grown $T_1$ transgenic plants overexpressing nicotine demethylase CYP82E4v2.
Figure 8:
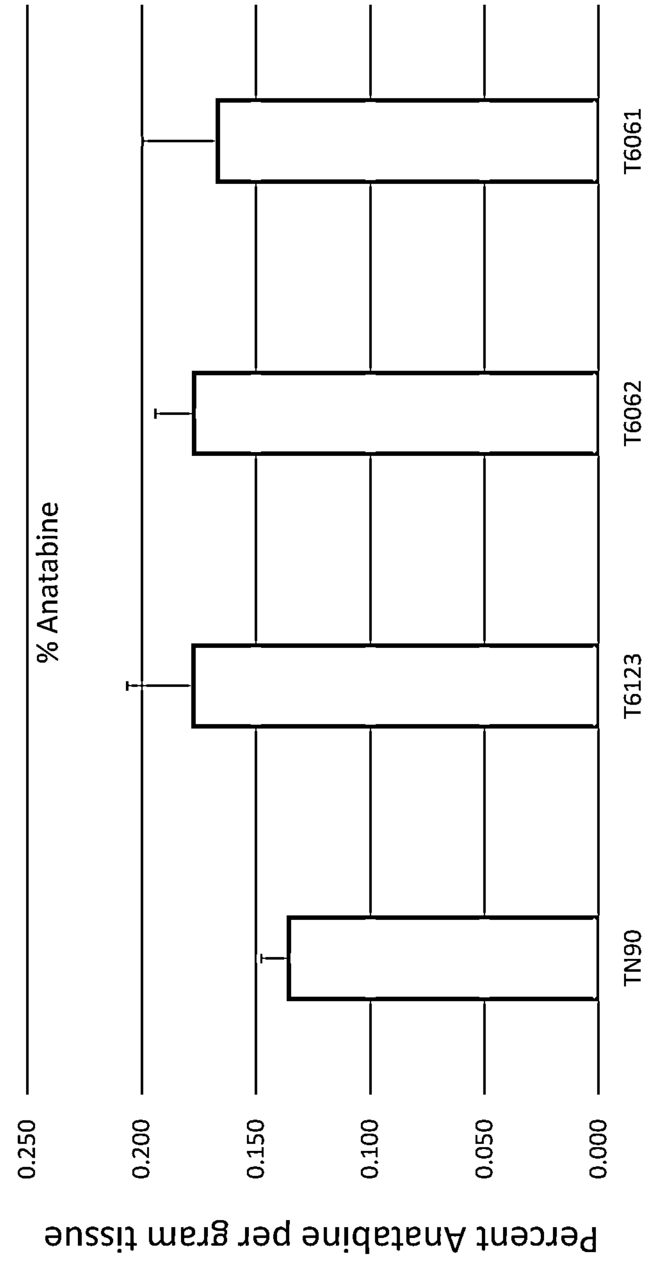
FIG. 8: Anatabine levels in field-grown $T_1$ transgenic plants overexpressing nicotine demethylase CYP82E4v2.

Example 2: Overexpressing Nicotine Demethylase (Cytochrome P450 Monooxygenase CYP82E4v2) to Decrease Nicotine Content in Tobacco The coding sequence for the nicotine demethylase CYP82E4v2 (SEQ ID NO:1) is incorporated into a p45-2-7 transformation vector, and modified tobacco plants are generated, according to Example 1. Modified HI BU21 tobacco plants ($T_0$ and $T_1$ generation) and control tobacco plants are grown for 4 to 6 weeks after transplantation to soil. Plants are topped at flowering stage. Two weeks after topping, the $3^{rd}$ to $5^{th}$ leaves from the top are harvested. The leaves are either freeze dried or oven dried. Alkaloids are measured from dried leaves using standard protocols. Compared to control HI BU21 plants, $T_0$ transgenic plants expressing CYP82E4v2 have decreased nicotine content (FIG. 1). Nicotine reduction is also observed in $T_0$ transgenic plants when CYP82E4v2 is overexpressed in LI BU21 and TN90 LC plants (FIG. 1). Also measured are nornicotine, anabasine, and anatabine levels in these transgenic plants. Nornicotine levels are elevated when CYP82E4v2 is overexpressed in all three backgrounds (FIG. 2). Both anabasine and anatabine show similar trends in their levels among various $T_0$ transgenic plants in that their levels correlate to each other without conclusive shift due to the CYP82E4v2 overexpression (FIGS. 3 and 4). Alkaloid levels are further tested in the $T_1$ generation in TN90 LC, e.g., a reduction of nicotine without increase in nornicotine, and a slight increase in anabasine, and anatabine (FIGS. 5-8). Worth noting is that the average nicotine level in CYP82E4v2 overexpression TN90 LC $T_1$ plants is around 1% of the nicotine level if control plants (FIG. 5).

Example 3: Overexpression of Antioxidant Regulatory Genes Reduces TSNAs

Figure 9:
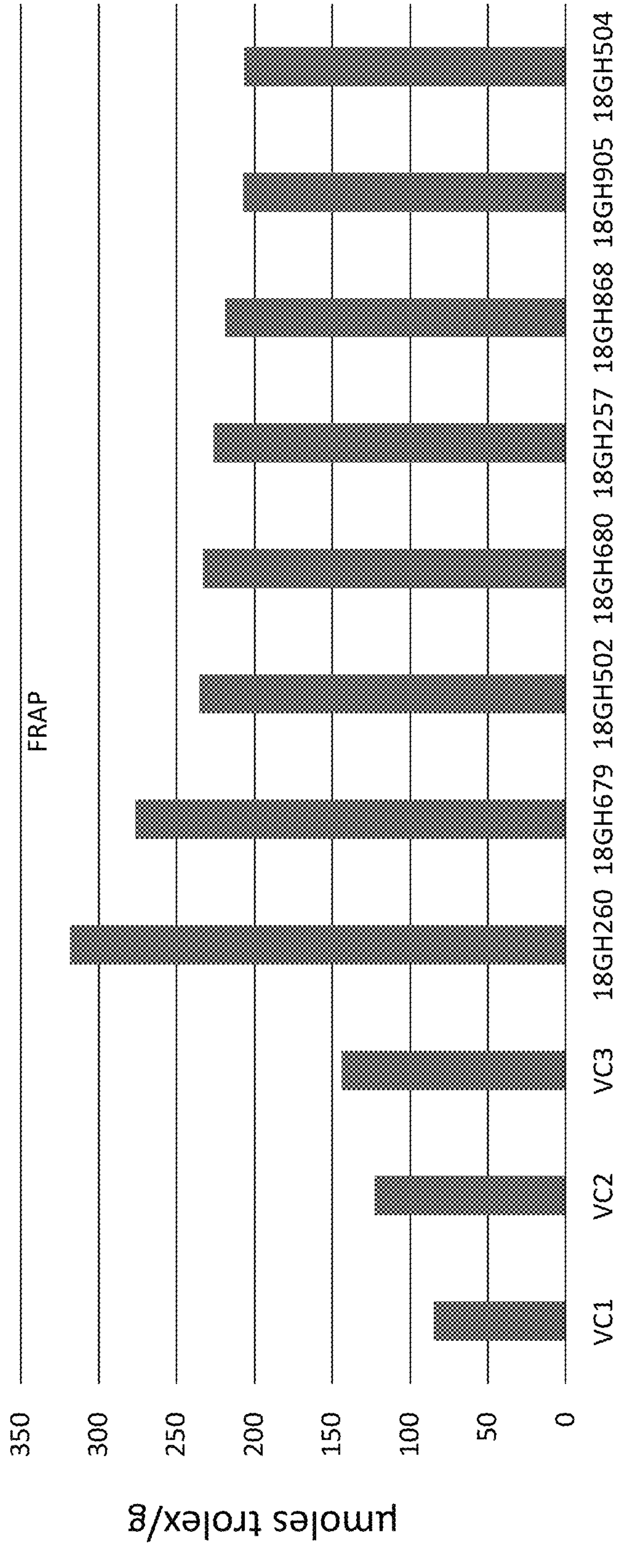
FIG. 9: $T_0$ transgenic plants overexpressing Myb3 in LATN90 exhibits increased level of antioxidants as measured by a Ferric Reducing Antioxidant Power (FRAP) assay.
Figure 10:
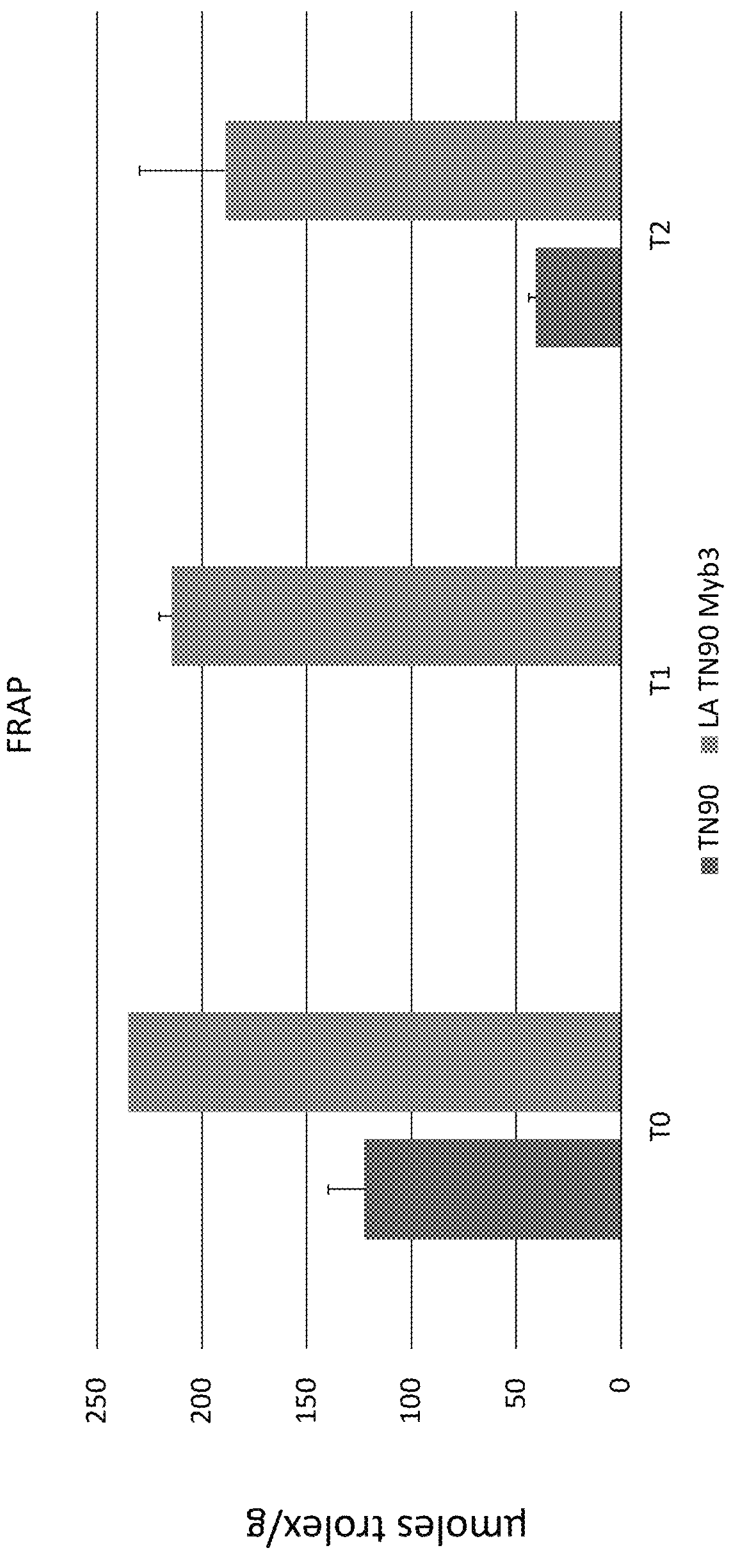
FIG. 10: Increased level of antioxidants observed in three generations of transgenic plants overexpressing Myb3.
Figure 11:
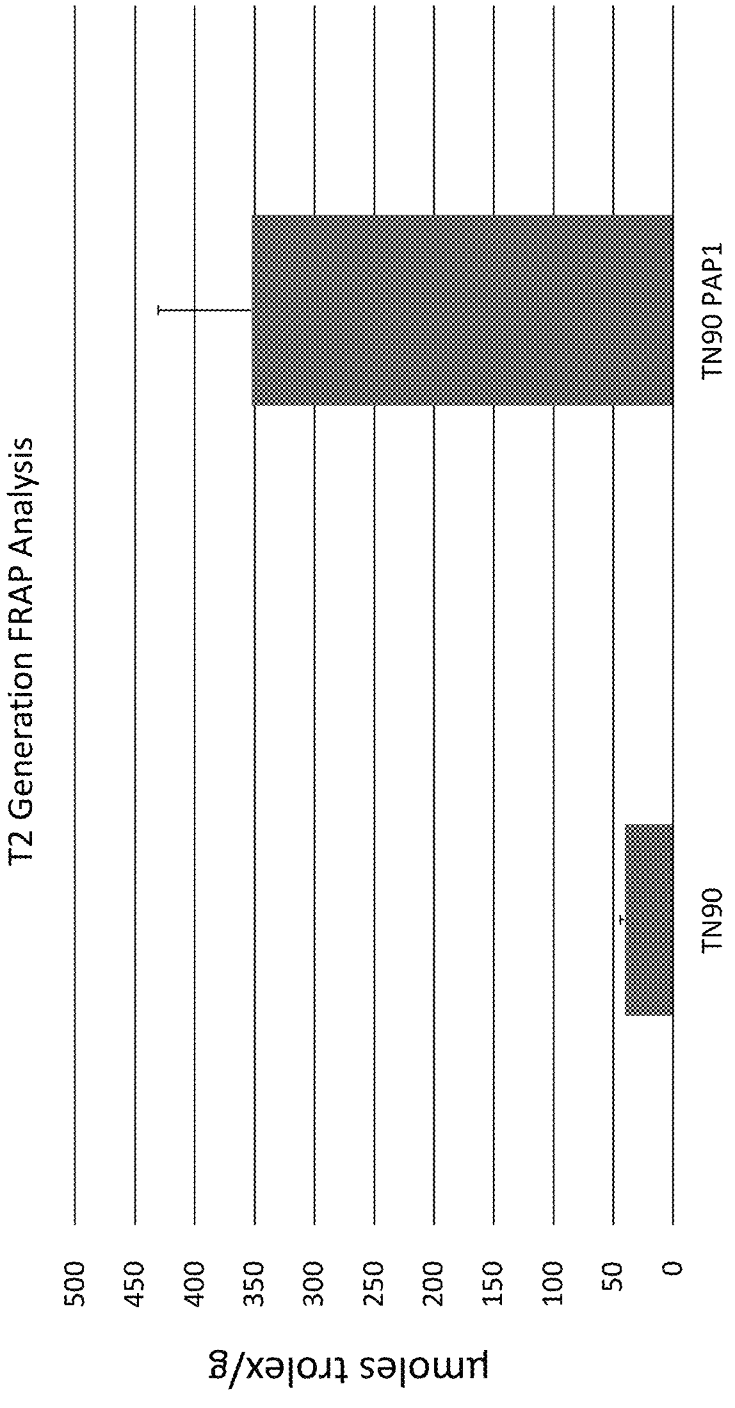
FIG. 11: $T_2$ transgenic plants overexpressing Myb3 in LATN90 exhibits increased level of antioxidants as measured by a Ferric Reducing Antioxidant Power (FRAP) assay.

Coding sequences for antioxidant regulatory genes *Arabidopsis thaliana* PAP1 (SEQ ID NO:2), *Nicotiana tabacum* Myb3 (SEQ ID NO:3), and *Solanum tuberosum* AN1 (SEQ ID NO:4) are incorporated into a p45-2-7 transformation vector, and modified tobacco plants are generated, according to Example 1. Modified HI BU21 tobacco plants expressing CYP82E4v2 and at least one antioxidant regulatory gene (To and $T_1$ generation) and control tobacco plants are grown for 4 to 6 weeks after transplantation to soil. Plants are topped at flowering stage. Two weeks after topping, the $3^{rd}$ to $5^{th}$ leaves from the top are harvested. The leaves are either freeze dried or oven dried. Alkaloids are measured from dried leaves using standard protocols. Plants with low alkaloid amounts and high antioxidant amounts are selected and grown in the field. The selected plants, as well as control plants are topped and leaves are air cured and tested for TSNAs. Plants expressing *Arabidopsis thaliana* PAP1, *Nicotiana tabacum* Myb3, or *Solanum tuberosum* AN1 demonstrate increased antioxidant capacity and reduced amounts of TSNAs compared to the unmodified control plants. Overexpression of any gene that increases the antioxidant capacity in tobacco plants is useful for decreasing TSNAs in Modified HI BU21. As shown in FIG. 9, To transgenic plants overexpressing Myb3 in LATN90 exhibits increased level of antioxidants as measured by a Ferric Reducing Antioxidant Power (FRAP) assay (FIG. 9). This antioxidant increase is observed across 3 plant generations (FIG. 10). Similarly, $T_2$ transgenic plants overexpressing Myb3 in LATN90 exhibits increased antioxidant capacity (FIG. 11). Used here, LATN90 is a TN90 variety with nic1 nic2 double mutations introgressed from LA BU21.

The Ferric Reducing Antioxidant Power (FRAP) method is based on the reduction of complexes of 2,4,6-tripyridyl-s-triazine (TPTZ) with ferric chloride hexahydrate (FeC13·6H2O) which forms blue ferrous complexes after its reduction (Benzie & Strain, 1996, Analytical Biochemistry, 239, 70-76). Three solutions are used for the assay: Solution 1) 10 mmol-L-1 solution of TPTZ (0.07802 g/25 mL), in 40 mM of hydrochloric acid; Solution 2) 20 mM solution of ferric chloride hexahydrate (0.13513 g/25 mL) in ACS water; Solution 3) 20 mM acetate buffer, pH 3.6 (weight of sodium acetate trihydrate is 0.27216 g in 100 mL ACS water, adjusted to the desired pH using HCl). These three solutions (TPTZ, FeC13, acetate buffer) are mixed in a 1:1:10 ratio. A 245 μL volume of the mixed solution is pipetted into a plastic cuvette with subsequent addition of a 5 μL sample (gallic acid, Trolox®). Absorbance is measured at primary λ 593 nm wavelength. Different concentrations of Trolox® was used to make a standard curve and samples are compared to standard curve. Total antioxidants are calculated using the following equation $$\text{Antioxidants (nmol/mg)} = \frac{\text{nmoles present in the sample } X \text{ total sample extraction volume}}{\text{total wt of the sample } X \text{ volume used for measurement}}$$

Example 4: Using Overexpression of CYP82E4v2 and Tobacco Myb3 to Reduce Nicotine and TSNAs and Improve Leaf Quality

Figure 12:
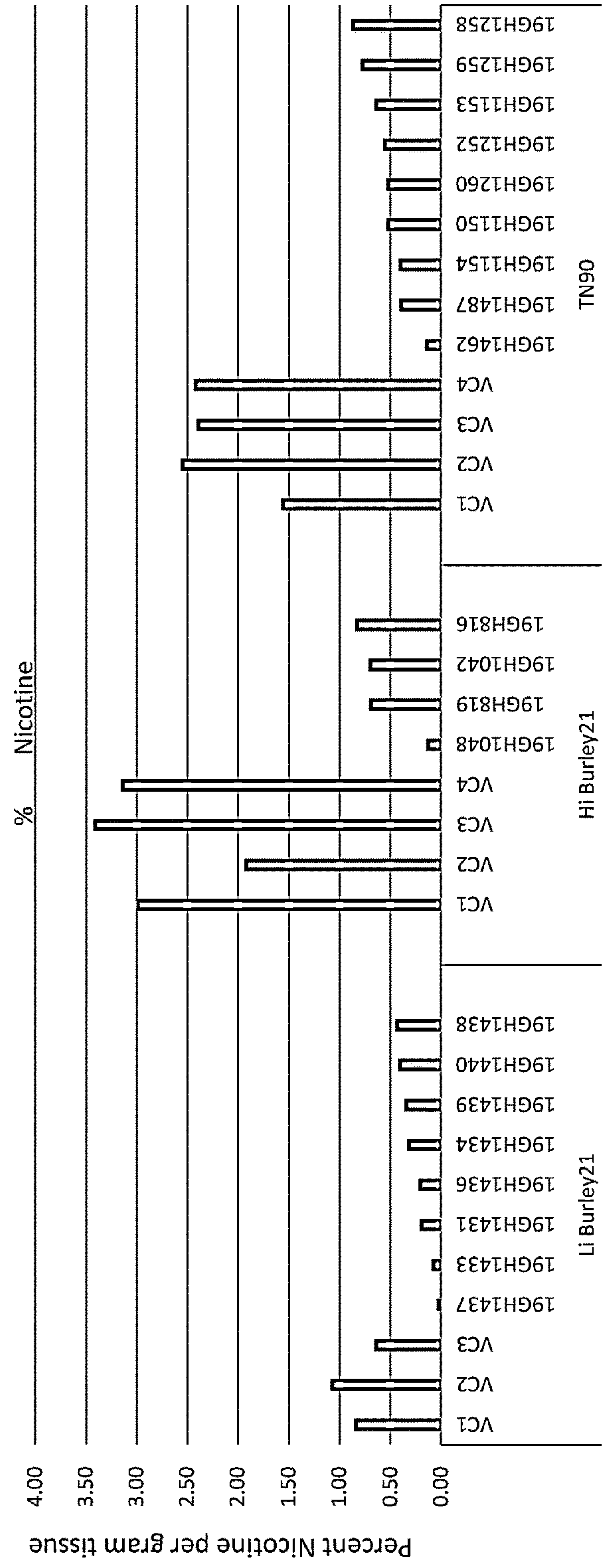
FIG. 12: Nicotine levels in greenhouse-grown $T_0$ transgenic plants overexpressing nicotine demethylase CYP82E4v2 and Myb3.
Figure 13:
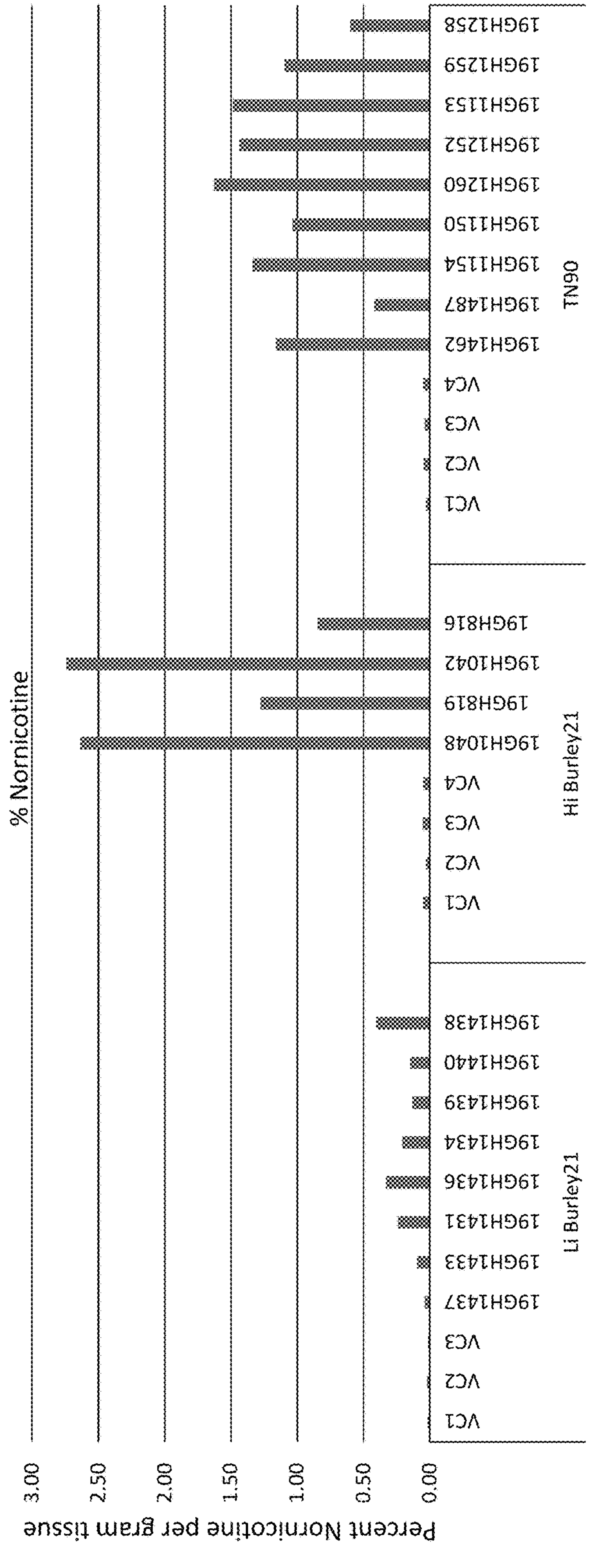
FIG. 13: Nornicotine levels in greenhouse-grown $T_0$ transgenic plants overexpressing nicotine demethylase CYP82E4v2 and Myb3
Figure 14:
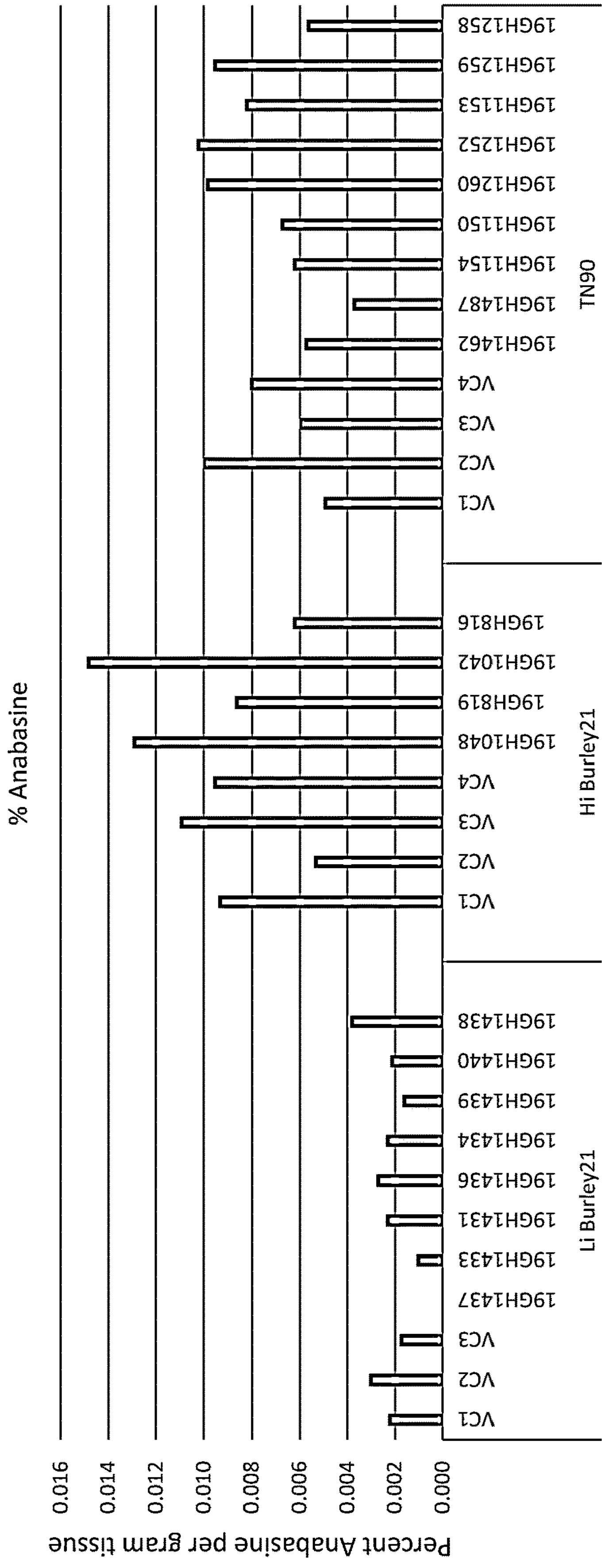
FIG. 14: Anabasine levels in greenhouse-grown $T_0$ transgenic plants overexpressing nicotine demethylase CYP82E4v2 and Myb3.
Figure 15:
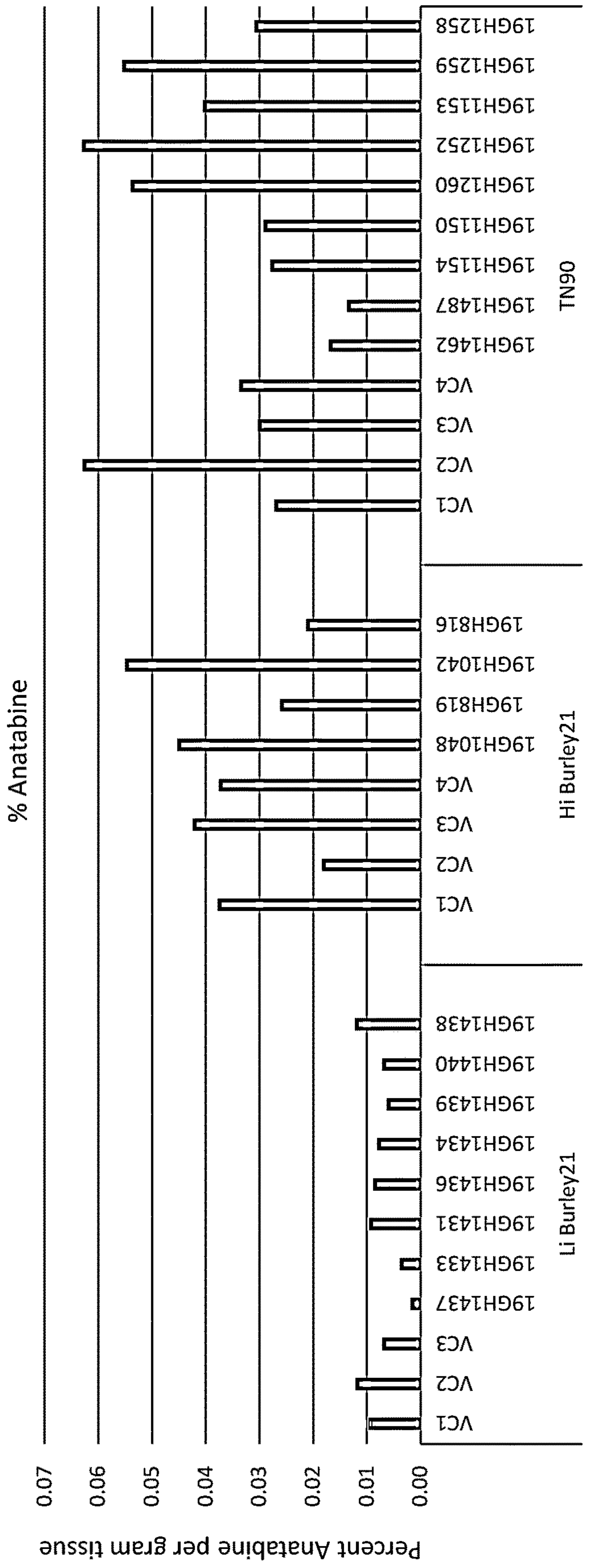
FIG. 15: Anatabine levels in greenhouse-grown $T_0$ transgenic plants overexpressing nicotine demethylase CYP82E4v2 and Myb3.
Figure 16:
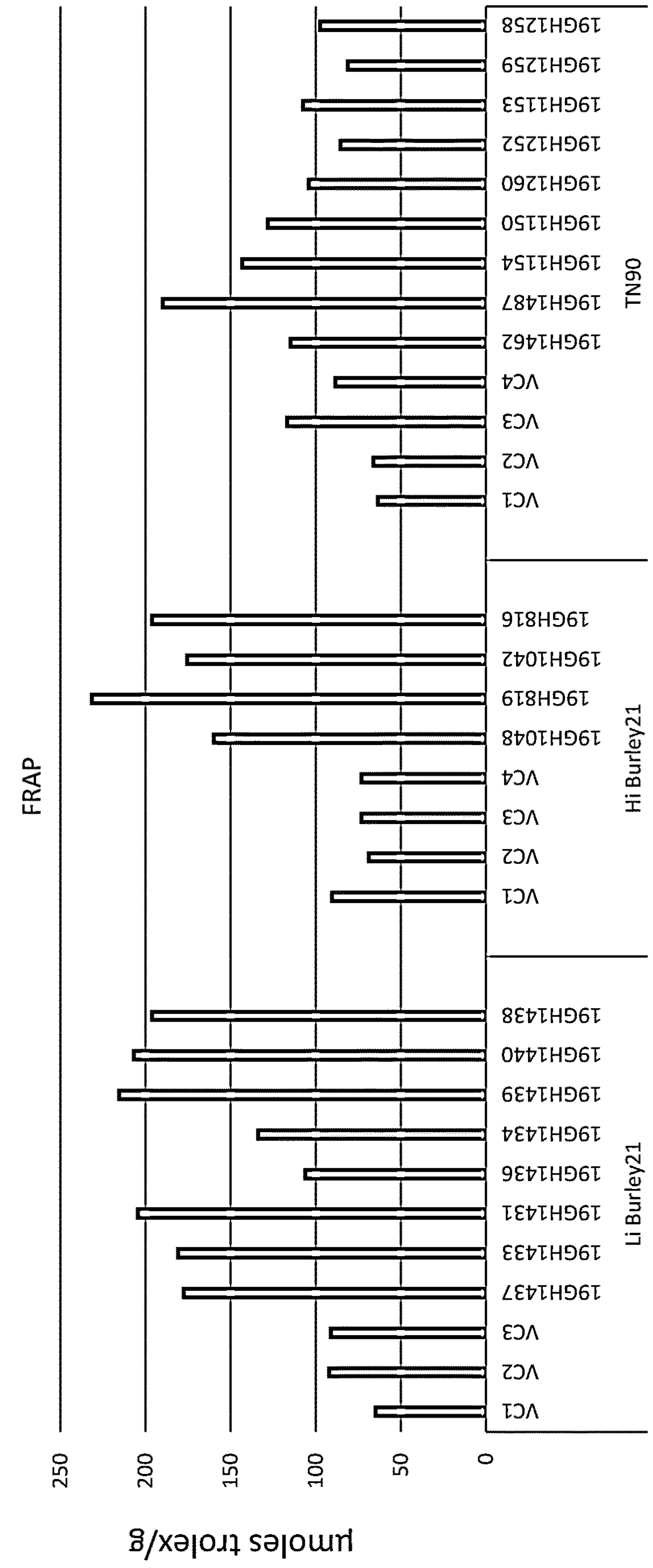
FIG. 16: $T_0$ transgenic plants overexpressing CYP82E4v2 and Myb3 in TN90 exhibits increased level of antioxidants as measured by a Ferric Reducing Antioxidant Power (FRAP) assay.

*Nicotiana tabacum* Myb3 (SEQ ID NO:3) and CYP82E4v2 (SEQ ID NO:1) are incorporated into a p45-2-7 transformation vector and used to generate modified tobacco plants as described in Example 1. Modified tobacco plants ($T_0$ and $T_1$ generation) and control tobacco plants are grown for 4 to 6 weeks after transplantation to soil. Plants are topped at flowering stage. Two weeks after topping, the $3^{rd}$ to $5^{th}$ leaves from the top are harvested. The leaves are either freeze dried or oven dried. Alkaloids are measured from dried leaves using standard protocols. Compared to control plants, plants overexpressing CYP82E4v2 have decreased nicotine content. Plants with low alkaloid amounts and high antioxidant amounts are selected and grown in the field. Overexpression of Myb3 is confirmed using standard molecular techniques. Modified and control plants are topped and leaves are air cured and tested for alkaloids and TSNAs using standard protocols. Plants expressing either *Arabidopsis thaliana* PAP1, *Nicotiana tabacum* Myb3, or *Solanum tuberosum* AN1 that also express CYP82E4v2 are tested for nicotine and TSNA levels compared to the unmodified control plants. As shown in FIG. 12, $T_0$ transgenic plants overexpressing both CYP82E4v2 and Myb3 contain reduced nicotine compared to vector control plants in all three tobacco background, TN90, HI BU21, and LI BU21. Conversely, $T_0$ transgenic plants overexpressing both CYP82E4v2 and Myb3 contain increased levels of nornicotine compared to vector control plants in all three tobacco background, TN90, HI BU21, and LI BU21 (FIG. 13). Again, Both anabasine and anatabine show similar trends in their levels among various $T_0$ transgenic plants in that their levels correlate to each other without conclusive shift due to the CYP82E4v2 and Myb3 overexpression (FIGS. 14 and 15). If anything, TN90 may exhibit a slightly higher average level of anabasine and anatabine relative to average control levels. Furthermore, FRAP assays demonstrate that CYP82E4v2 and Myb3 co-overexpression also increases antioxidant levels in all three tobacco background, TN90, HI BU21, and LI BU21 (FIG. 16).

Alternatively, HI BU21 (or LI BU21) plants are co-transformed with nicotine demethylase and Myb3 overexpression constructs. Callus color (e.g., purple or crimson) may be used to select for Myb3 transformants. Further, a tobacco plant overexpressing AtPAP1 is transformed with a nicotine demethylase overexpression construct. Additionally, a nicotine demethylase overexpression plant is transformed with an AtPAP1 (or Myb3) overexpression construct. In addition, a single construct harboring two or more expression cassettes stacked (e.g., CsVMV-NtMYB3-Nos-T-CsVMV-CYP82E4-Nos-T as set forth in SEQ ID No. 44) is used to transform HI BU21 (or LI BU21) plants. Transformants are selected and tested for nicotine and TSNA levels.

Example 5: Crossing of HI BU21 (or LI BU21) Plants Expressing Antioxidant Regulatory Genes into Burley Converter Lines Burley tobacco lines that demonstrate a high conversion of nicotine to nornicotine (stable converter lines) are crossed to HI BU21 (or LI BU21) plants expressing antioxidant regulatory genes using standard techniques. Stable $F_2$ plants are tested for nicotine levels. Antioxidant analysis is conducted to test antioxidant capacity for these plants compared to parental Burley converter lines. TSNA analysis is used to assess levels of TSNAs compared to parental Burley converter lines. Alkaloids, antioxidant capacity, and TSNAs are measured using standard techniques.

SEQUENCE LISTING (45 sequences)

SEQ ID NO: 1 - DNA, 1554 bp, Nicotiana tabacum
  source 1..1554: mol_type = genomic DNA
atgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaa

SEQ ID NO: 2 - DNA, 897 bp, Nicotiana tabacum
  source 1..897: mol_type = genomic DNA
atgggaagaaaaccatgttgtgtaaaagagggattgagaaaaggtccatggtcttctaaagaagatttattacttactaattatatcaaggaaaatggtgaaggacaatggagatctttgcctaagaatgctgggttgcttaggtgtggaaaaagttgtagactaagatggatgaactatttaagaccagggattaaaagaggaaatttcagtcaagatgaagaagatcttatagtgagactacattctcttttgggtaatcgttggtcactaattgctggaagattaccaggtcgtacagacaatgaaatcaagaattattggaacacacatttaatcaagaagctcaaaaatgctggaattgaaccaaaaccccacaaaaatttctccaaatgttccaaaaaggaatcaagaaaaggaccccaacaagggaaatcaagaaaaatacaaggcaaaaagagcaacaacaaaaacaataagggtcaaattgtacaagttgagaagaccaaagtatttttcccaaaacccatcaggatttcttgtggaatttcaaggaacaatagttttgaaaatgttacattgagtactacttgttcctcaaatagtaattctggagaagctaatcttgaaaacaaggaaaatgaggtgaaattagaagaagtttcattctttccaagggacttagattttggtaaattacttgaaggggatgcaatttatgatgaatttctaatggaagaaagttgccacatttcaaacaaatgttcattgccaatgaatgagagcatgttggagaaagtatatgaagaatatcttttacttctttctgaaaattgttaccttcaagatgatcatcaaaatgagcaaaatttccctgtaaatgtttctgatcagtga

SEQ ID NO: 3 - DNA, 747 bp, Arabidopsis thaliana
  source 1..747: mol_type = genomic DNA
atggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatgccttggacttaacatcaataatgtttgtgacaatagtatcatatacaacaaagataagaagaaagaccaactagtgaataatttgattgatggagataatatgtggttagagaaattcctagaggaaagccaagaggtagatattttggttcctgaagcgacgacaacagaaaagggggacaccttggcttttgacgttgatcaactttggagtcttttcgatggagagactgtgaaatttgattag

SEQ ID NO: 4 - DNA, 777 bp, Solanum tuberosum
  source 1..777: mol_type = genomic DNA
atgagtactcctatgatgtgtacatctttgggagtaataaggaaaggttcatggactgaagaagaagatattcttttgaggaaatgtattgataagtatggagaaggaaagtggcatcttgttccaactagaactggattaaacagatgcagaaaaagttgtagactgaggtggctaaattatctaaggccacatatcaagagaggtgactttgaaccagatgaggtggatctcatcttgagacttcataagctcttaggcaaccgatggtcacttattgctggtagacttccaggaaggacagctaacgatgtgaaaaactattggaacactaaccttctaaggaagctaaatactagtactaaatttgctcctcaaccacaagaaggaattaatactagtactattgctcctcaaccacaagaaggaattaagtatgggcaagccaatgccataataagacctcaacctcagaaattcacaagctccatgaagattaatgtctcttggtgcaacaacaatagtatggtaaataatgaagaagcatcgaaagacaacaacgatatgcaatggtgggcaaatatactggaaaactgcaatgacattggagaaggagaagctgaaagaacactaccttcatgtaaggaaattaattgcaatgaaattgataaagcaccaagtttgttacatgagggaggcaactccatgcaacaaggacaaggtgatggtggttgggatgaattttctctagatgatatatggaatctacttaattag

SEQ ID NO: 5 - protein, 517 aa, Nicotiana tabacum
MLSPIEAIVGLVTFTFLFFFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 6 - protein, 298 aa, Nicotiana tabacum
MGRKPCCVKEGLRKGPWSSKEDLLLTNYIKENGEGQWRSLPKNAGLLRCGKSCRLRWMNYLRPGIKRGNFSQDEEDLIVRLHSLLGNRWSLIAGRLPGRTDNEIKNYWNTHLIKKLKNAGIEPKPHKNFSKCSKKESRKGPQQGKSRKIQGKKSNNKNNKGQIVQVEKTKVFFPKPIRISCGISRNNSFENVTLSTTCSSNSNSGEANLENKENEVKLEEVSFFPRDLDFGKLLEGDAIYDEFLMEESCHISNKCSLPMNESMLEKVYEEYLLLLSENCYLQDDHQNEQNFPVNVSDQ

SEQ ID NO: 7 - protein, 248 aa, Arabidopsis thaliana
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKKHEPCCKIKMKKRDITPIPTTPALKNNVYKPRPRSFTVNNDCNHLNAPPKVDVNPPCLGLNINNVCDNSIIYNKDKKKDQLVNNLIDGDNMWLEKFLEESQEVDILVPEATTTEKGDTLAFDVDQLWSLFDGETVKFD

SEQ ID NO: 8 - protein, 258 aa, Solanum tuberosum
MSTPMMCTSLGVIRKGSWTEEEDILLRKCIDKYGEGKWHLVPTRTGLNRCRKSCRLRWLNYLRPHIKRGDFEPDEVDLILRLHKLLGNRWSLIAGRLPGRTANDVKNYWNTNLLRKLNTSTKFAPQPQEGINTSTIAPQPQEGIKYGQANAIIRPQPQKFTSSMKINVSWCNNNSMVNNEEASKDNNDMQWWANILENCNDIGEGEAERTLPSCKEINCNEIDKAPSLLHEGGNSMQQGQGDGGWDEFSLDDIWNLLN

SEQ ID NO: 9 - DNA, 1827767 bp, Nicotiana sp.
  variation 73101..74100: note = a, c, t, g or not present
  variation 710005..711004: note = a, c, t, g or not present
  variation 1059235..1060234: note = a, c, t, g or not present
  misc_feature 1..1827767: note = See specification as filed for detailed description of substitutions and preferred embodiments
  source 1..1827767: mol_type = genomic DNA
ctgccctgatggctaaccctgatggcctatagacccactggaagaagcctgaatagccggtggacattatgaacactccgacatagcactaaaataagaatcaaaagaaccttgtggacctgaataaccgccggaggaaccctgaatagctagtgggcggtaagaactctccggcaccgcactgaaatatggtctcactggagcacctcggggaggtggtgatggtgctgaatacaggggtctactaggctggcccttcccgaagtgacctctacccctagctggggcacctctgaactctcccgagaaccgggccctcttgtcctactgaatctgctctctacccctctggcgatatccctaaatcttgcgagcaatctttaccactagctgatactcagtacccatctccacctctcggccatgctagctcgaataccggggtgcaaccccgcaacaaatcttcgcaccctctctacatcaatgggaagtatcatgagtgaatgacgagacaactcagaaaaacctcacctcataataggtcacggacatctgaccctgctcaaaatgctcaaactgatatcgtagctcttccctctcagatgagcgcttctgcggtttggcctggccagctctgggccatatctgtgaggctacgaccgcttctgtggtttcgcacctgcggtcaaccaaccgtaggtgcggttatgatagaagcagatgcttcagcatttctccaaattctcaacttcactcgagcctcgtccgtttgacgctctgggctcccgggccccgcccgaacataccgacaagtctgaaatcacgagacggaccaactcgaacctctggaacgcccgaaacaatgctaaatctaagagtcaccccttaaaaccaaatgaatcaaacttatgaacttcaagttcttaattttcgtctaacgagtcgaaacgccctaaaactactcggattgataccaaattttgcgggcaagtcttaaatgatatatcggacctatgccgggctccggaaccaacatacgagcctgatactcatggaaccaatcattaattagtttctttaaatctttaaaacttcatattaacaatttctgatataaattcattactccggctaatgacctcggaattcgattccgggcatacgcccaggtcccatattttcctacggaccctctcggactgtcaaatcacgaatctgggtccgtttgctcaaaatgttgaccaaagtcaaacttagccttttaagaaaattctaaggaatcaaatgggcatatttcactccaaactcttccaaatcccgaacctaccatccccgcaagtcgtaaattagttaaagcaagtgcggaaagttttatttaagggaacagggttctaaaaggcaaaacgaccagtcggatcgttacataaagtttgtaaaatatatatatttcatgcacataatataaaataattatttaaataaagctacttttattatatacattatatattcttgaaaattatgctcaattgtattattatatttctaccaacttttcaatgacacaaagttatatcaccggaaagcagggagactatctgtataggataaaatatgctatgttaagttgtgcatggaatatatataatataattgagcaaattattcaagaatatataatgtatattataaaagtacctttatttaaataattatttttatgttacgtgcatgaaatatatattttacaacctttattttctttcattttaaattgtgcaaataaatttttaaatttttgctattaatactaaaattattattacgaacaaattattctaattaatttttttactcgatatccgattttacaatgtcttcaacttatattaaagcaattaccaatatacagcaggcatcactttcaagcattgttgcgttgcagacccatactccttattcctcatataattcccttttcgaaagcagtccaaagtttataagaatttgaccggtgattagacatgtacaagttaatctcctaggagacagagctgaagccgacatatatatcccacattcatgcactacctactcacgaaaccataatactaatgtccaacaccctccatccctgaattcctaaacctatatatatacatcatcattttcctatccctttgccactacgtacaccacattcacaaaaagaactttaatataaaaaaaagatgcagggaatatcattagagtttgatcagcaaaattttcttgacaccatgcagcatctcttcaatgatcccgactttccccaaatcttttcagaactaaactcattcaataacaccatccaaacacctagaaacccaggttcagagaacaccatatttgcacaaaacatggttcaacgcaatcaagaaaaatatgcagatgatcatatcgtcccattgcaaaagacttcgtcagaaaatgataaggagccatcttcagatcaggtgcctttggaaaagaagaaatacaaaggagttaggagaaggccatggggaaaatatgctgcagaaataagggatcctgaaagaaaaggcgctagactttggctagggacatatgaaactcctgaggatgcagcattggcttatgacagaactgcatttaaactgcgcggttcaagagctgtactcaatttccctcacttgattgaatctaatgttactgaaattaacagagtgaggccaaggagacgttcacgttcaccggatattgagctttcatctgatcagcatgatggtccgatttcaaagaggagaaatgttgacctaattaacagcttagctacagccaacttggatagccaaattatcgtggagagatgtttaacgtctagtttttttgcctgaagaaaatctaacacttactacaacattatgcatcaacggctacaaataaaaaatcgtggctattacctagcaatagccataaaaattgaaatttcgtggttgttcacaatttggtgaaatttcttggctacaataagtaaattgacaaagctaattccttctttttgctataattggttagtatcgtaataataactacaaaaatagctacacatttactgctacattataaatttatagctaattgttagtttttgccatgtatttaaattattgtagcaataaaaaaaaatttaaccacaataaatcatgtcaaataaaatatcgaatatttttccttcaagttgtaaaaatcgtggcaataattggctcaatagatacgatgaatatcatggcaaaataatatagccacaaatttatatagctacaatatttattgaagctaattctaagttttgctatgcatttgaagtcactgtaataattgtaatcttcaagccatgatacatttgtttgcacataattctatagctaaaaaaatagtcttgtttcaattttcaaaaatcgtagcaactgttgggacatatatgctcaggattttaggcactaaggccacattcatccatgagccactttgtcagcttgaattttgtaacaatccgactggtagttttgagtatttgcacttcgctcggtgttttgagagctccagtatctccgcatgatgtattataacttgtgtaaatcgttggtattgattttcaagttatccggaatcgatttggaagaatgaacttcaagatttaagttttaagttggaagaactgaccaagtttgactttttagtatttgacatcgaaatggagttttgtcagttccgttaactcagttgagtgattttggacttaggagcgcgttcggattataatttagaggttcgtaatcgaattactcttgaaattgcgaaagttggatttttgagaagtttgagcggagaggactttttgatatctgggtcggattccaattttgaaagttggtgtaggtccgtaatggcaattattacttgtgtgcaagatttcaggtcaattggaggtgatttgataggtttcggcattggtcgtagaagttgaagtttcaaagttcattaattttgacttgaggtgtgattcatcatttcgatattgttatgcatgatttgaagcttcgagtaggtttgttttgtcatatagaacttgtatgaaaaatttggcgctattcggagttgatttgatatggtttggacgctcggttgtaattttagaagttcttgaagtttaagttaatcttcatgcgttttggcatccgattcgtgcttttggaggttattttgatgttttgattgcgcgagcgagttagtataatatttttagacttgtgtgcatattttgtttagagccccaagggctcggtgagtttcagattggtttcagaataatttttcataattcttgagtgctggttctagttttgtcgcatttgcgatgttttggtcgcaaatgcggccatcgcatttgttgatatccaattttttcctatgtatttttatacccaaaaaacttccaaaataacatatatgcgcatatataagcacaccaaaaggttttggcattttaatgatttttaaaccaatttatgacctattttacatcataaaatccaataactattcccaaagcttgccattttggagaataatttattttattctcatatttacgccaaaatatatccagcatgatttttacacattttttacaaattcgtttggtatttttaaagccaaattgcatataattgcaatactagcctctttaagatttaatagcattttataattacaaaattgatcccaatattttcaaattaatatttatatattattagttgactcagtgcctttaatttgcttttaaaatatttttactatttttataaaataataaaaggaaaaattggctatttcaattgtagcctcaattcatttcaattataacccaaattccatttcaatttcaacctgaaatcagcccaattttgaactcaattggaccagcccaattcattcaaacccatccccttgacccgtttaatccaatccttttaatccaggccgttaatcattttgatcaacggccacaaacgaccctttttttttaattctaccaacccccaaccctaacccttatttctcttagacaaccgcctctgaaacctcttctctctcaaaacgctctcaagcactcgaaaccctaatcgcctccctcgtcttctccgaccattatctcgccggagtccatggcttttcaggccatggacaacttgtgctcaccttccttcactcctaagccatgggtgttcaagatttcgaggtttgatctcaacggcgttcgttcagatcttcttagatctgtggttctatggcctctccggccttgctccgacgaattcgtgctttagaagcctagccatggccatctctgactcaagaccagacctcttctaagccttctcatttctagggtttcagagaaaccctaaagctattcgaggttccttcctcttttatttacttagatctgtgatgcatccgtgctatattcaacgttttaaagcttttccccaattttcttttcaaaattagttcgctttcaatttagggttttcgaaaaaatctcaaaataacttccgactcttcttcttcttcttttctttgtgtgactctgtctgtaccacgttcttatgagtttttctcttatgttcttatgtttgccatacgatacatgttcttctatttttgtgttctgttcttccctctactgggttctataagcatgctttacatgtctatctcgtatgttcctctactgtattttttactaagcttttgctccttgcctacctttactggactttgtttgaaccctaagcatgtttcatctactattttcctaaacccgtatcgctttttcttttctgaacttgtttgagtgacaagctttgcctaaatgtattccctgtgtttcaaacttgttgttatctctgtttgtttctcataagtctctgaaagagactactgagcctgttctatttgttgttttctcatctatgcatctgatttgagtcagaaaccctagtatttgggggttttttttggcaagcttgactttgtgtttggactagggttccattcagaaccctgactctctttcagactcattctgattctatgaacctaaccttcttgggtactctgatttcttgctagttttacaacaactctctcttgtctcacatgtctgtatgctttttatatgacaagttctcttctttcaaaaggcctttgtccagcttgtgattgattccgagttccatttttaaaagttttgattgtgtgttgttaagtttcttcaaatttaacccttctcacctttttctggttggattcattcacactaagattcgaatccttattttacgggctggttgattgattgtctttccttgtttgacctaaaccgtgtactactaaactgtttccttaaataggtttttgtgtatttgcccctgttatattgcctcagaaaagattgtttaaaacaaatcctttccttatttatttttgcccgtttgaatcaaatcccttaaccaaagggaaacagcttgtgattgatttcaaaacttttctcttacctttttttactcaccttctgcactataaaagggaatgctcttttgcactaaagaaagggttttacagatgctttcacagacttttctgcacaaaaacacaggcttttacacattcgaatactgagttctttcacaaaaaaaattatactctcttcttctactttgtgctttctgaaacaattttgagctctctctctaaaactctcaagtgttctgctgaacttaagtgtgctcctactgtgtttacttgccatgattgctctattattctgcttgttcttactttgcaactggtacgttattcttagttgaataatgcttcttcattatgtgtttacttcctagtctgttatgttcttctttactatatttctgcaaccctgttgtgcttttcttatgtgaactccctttcccttttcccctttgtatgtgagtatagttccggccatcacatcactttgatattgttgtctatgactctgaactgggttctttgaacctcataactcaatcaattcccactcccttctcccctttatgtgcttgagcctggacctgagtctggtggtgtcctaatcaccatccagacctaggtttgaccctcaagggtctgctcctaacttgtttgaccaaacaaatgtcaggggtatgccagtctgcacctgtggctgggtatgaccaccatttgttatggctccccaattccttttcactttgcacttactcctagatctaagttctgcccctctcttgcaagccatgctttgggacccttgagctcccactgaacttggatgcctgaggactggctattccgcactgcactattctaattctaaatggtatcctgagtgtaagcaatgctgggaatccttgagattccttggaactttgaaacactttggataaagagaaggctttggaaatccggaattggttaatcacatgttattggacattaagattgaattaggctgctcggatctagctgttagtttttactgtatttatttcctttcttttggtatgtaataatttgtataaagaatttggggaatgtagtaaaagggtgtgggaggggttatacattcttgcatcagtaaggatagaaaccatgctttaggattttaattttttttagaaatcctgcctataggattgttcaatatttctgattccacattacttagagaccatgcctatagggtcaacgctttattgtgctacaaatcacatagaaatcatgcttataggacttaacgtttatgtaatcaatgcatatagagatcatgcctataaggaatgcatatgcattaggcaaactgtagggttaattaacacaatcatcttttacaagttcaataacaggttttaaagtcaaaatagatatcatgcctataggatttgcatcaaactcgtctgattcgcttaaagtaataatgatatattaactggtccttaacgtcttaatacaacaacgatttcagaagtcttaattctttgacaaaaactctcttgactcaatatgcttttaagtccctcaaatcggcatctttttctgaaatagtttctttctaaacattctgcctaaacattttactcagaccctgaaatcatcttttaaaacagttgcaacttaccctttccttagatatttctatctctgaaactctttcacaaccatttatgtattttatttttactgcagtctatactttctttttaaaactcctctgcattagactactttttcctgaaaccagtaccttttaaatcactcgcttgaaataccttaatttctgaattggatccaagtttcctaatgtagacattctatctaaacatatgggttgaaccagtccgttcactgtttaagtttaatttaaagaccaaatcagtatatgccaagatatgctaaactaagtgtttgtttgattaaggggtttacttgagccttacctatttgttttgttcatccttatatttgttacttgttttgtgtgtcgcaattagaattttaacctttgaactccatatatgcctatatccctttccttcccctttaggattagaagtcctgataccccgggactgataggttgggacgggtactagaatgcaataagtaaacgagactgatcgcgtttaaataccttaacggggtgggaaaggtagaatatggatatgatgaccgatgcgctaatatcacgtgcgacccctcttctgaggagtgatcgctgggtattgcattgaagtgatccatattaattataaacttatgactcccctccctttattttctttcatctcttcttgtaaaactgttcaaatctctttttcatgaatttctgccctctctacttacttccgaaaattttcaagttggtcgcaatgttatgtgcgaatacttatttgagacttgactgtttacttgtaaagtcacaattataacatggccgagaaccacactagtggatcttgaggggtgcctaacaccttcccctcgagataatttctagcccttaccctaatctctagtctcttcatctcaaacccttcttaaagtgtcctaatgcactataatcattaggtggcgactcttcaacttctaaacccaattctcgaaaggggatagagttgtcctcccaatgtcgtatacccgatttctgaccccgcggttagagaaaaaggtggtgtcgacagcatgtcgactctgctgaggagtttctttaggcttttaccaatgcatgttgtttgtgactttattatctcattaattgctttatttagtgtcttttattctttcactacgaaactgacttggctcttcatgtcttttctttcctttatctgctttcctttactactttatttcattgtttttgtaattactgcaattattgtaattcatttatcttatgaacgtgaaaatacatgacaatttgtttcattcttgtaaactgcatcttcaacatcatattccactcatgccaaacaaacaccatagcaacgcttataatgagtggttgcgctattccaatattatcaccttttaaattcggcaaaggcgtatttgcggtaaaaccagtcgatcaacggtgcagtcgacggtttcgtgcctttccctcttgagttgtccgctcaagggtacctgtctaataccccaacagaaaccctactctgtctaactgtgcatgcatcatggtcaaacctagccgagtcaattatgttgtccacataatgactcattaagatagccttgtccaaagtccatcgggtttccctaaaacccaaatagacacctacatgttatgtgcatttatttggagaactaaatgctttttatgctaattattggtttaaatagtcgagtgtggcagggtaagggtctaacactctattttgcagaaaatgaggtacgaagtccccagatttggcatggtcaccaacattcatccaaggctgctgaattggtgggatgatcgtcactctagtgatcagacactcgtccgcaaatacttagggaatctgccttctcttctaaaaatccagcatgacaacaaaatcatataggcttcaactctattctgggatagtgacaggtctgtgttctgcttcgggaaccttgaaatgactcctttgctcgaagaaataggaggcttagatggtattccttgggagactccgggcttgcttatgccagataatcacaggggtaagggtttccttaagatgatgggactgaagaagaacccagacttgacctgtttgaaagactcctacatcccattcgactatctgtacgagaggtacgaccatagcaagtcataccacacctactcagatgaatttgccctctcctcactggggcatattcacagaagggtcttcgtattcatgttttgtttcctggggatgatagtgttccctatgaagaaggctaggattcacaccatattggccatggtaaccaagactctgatggaaggaatcggcggacaacctttcaacatagtgcccatgattgttgctgagatataccgggatctggataattgtcagcgaaaggccagtcatttttagggatgctatttattacttcagctctggctcatagagcacctccagaaaggagaataccgacaagagatcttatgcagagactgggatgatcatattgccttccaccagccaaggcgtatgaattatatgcctaacatgttcgctcagccagaggacgctggaggatgggtggagctatttgagaatctaaaagaagaccaggtacagtggatggtcgaatggttccctacggaagaattcattgttcgatcccgagacgcaccgtttctcatactcattggtctaagaggaacttatccctacgttcccttccgagccatgaggtaggctggaagaaagcaaataataccaagggtcaacaaaatgagtcactttagggccgatttccaggacgatgatagccctcacaaatgccaagctcaacacatgtggcattgcaagctcgttttggggaaagaatctattgagctagacaggtatcatgctggttaggtgctgcactattcgggttggttggaagataatcataatggtataggtcagcccgggttcattcacggacacagaatcatcgacgagaaagctgaagcatgggttaagtacaatcaactgcgcaagaggattcgagagtgtgaaagtgagcttcgggaaatacaagaagcccatcagaagttgatcgaggaatggaaggatatggctgtcagtgccaacaatcgactagggtagttggagcgaggtctagtggagctagaaggaaagttcctcaagaggattgaagattgtcgaaacgctgaagggaatgcaggcggacatttggcccaagcttatctgctgctaggactgcgtgagctggtgaatctgttcgagggggataccgaatctagggaaggcccgtctgggaccaagtagttagaagtcttttattttgcttctaatgatgtaataaggccaatggccactagtgacattttagtttccgttatttagcgtcgctttggattcgtcttatttcttatcaataaaatgaggcatttagcattataagttctccaagttaatttgtcgctaggcctacctcagacacaacgaggcacccaaattaggacgcgatttatattcttgcacaatttgtttaaatattgcaacattttcttctcataacctgcactaacttgttacctttttgcttttctttattttttatcccctttccaaaggttagttcgtgcattctggaaccatcatcatacagtacgagatccaagggctctccacctcctcctcctccgagtcctatccgaaacaagagcaaaggtagaatgggagattcaagcgccagaaaggaaattgaaagaattgagattcctcagggtaccccagttgctaaggaaactgctgcccaacttgagcagaaactgttgaagttccaagaagaactggatcaagttcggaacttggcaaatttatcattcgctctcaccgctcctgatgtcaacttcccaaatgctcaaaatcccgcacctccacagaacaccctacaaccacatatacaacccacccatgctcaacattgcaacacatgccacactccactacccattcctgaaccactaaacaccacaaacgaccacccccacaacactcccatctacatagataccataccccactacactcaaccaatcttaagtgcacctaagtctgatgacaaggactctcttatcagaaacttggcagcagaactcaagaaattgaccagccgagtccagggcatggaaggaaacaaagacatagaggggctgaattatgaggacctctgcattcagccagatgttgaacttccggagggatataaacctcccaagttcgaaatgttcgatggcacgggagatcccagagtccatttgaggacatattgtgataaactggtcggagtcggaaggaatgagaaaatccgtatgaaactcttcatgaaaagcctgaagggggatgctttatcctggtacatcagtcaggaccccaagaaatggacgagctgggtaggtatggcatcggatttcatggataggttccaattcaatacagagaatgcaccggatgtattctacatccagaatctgaagaagaagcctactgagacattccgcgagcatgctacccgttggagatcagaggctgttaaggtcaggccggccttagaagaggaacatatgaacagatttttcgtccgggctcaagacccacaatattatgagaggttgatgctgatcgagggccaaaaattctcgtatatcatcaagctgggagaaagaattgaagaaggcattaagaatgttatggttactaatcttgaagcattgcaggcgaccaacaaggctttacagtctggtggcacgtccaagaagaaggatgtaaatgccgtgatggttgcacagggagccaaatcaccactaaaataccacacctacccgtcacctccacttacatatcagcctatcccgaattaccaagcacccgcaccctcttaccaaaatccaccacccgtttaccaatcatctccacctcccgcatatcaatccacttcacctagatactctcaacctacacctgtttagcaagcttataatgcccaaccccctcactaccaatcacctcccactcgccaaaatttccctatacccagaccaaattttgaccgcagacctcccagacaatatacaaccatcgctgagccaattgactagctgtatgagaaacttaaagctgctggttacatctcccctatccctgccataactccagaaaatccttcccagtggatcaaccctaataagacctgtgcgtaccattccggcatgcaaggtcacaccattgacgaatgccgctcgttgaaggacaagattcaaactctgatagacaataaggttatcatagcaaagaaacctgctcctaatgtccgcaacaaccctctgcctgatcacagaggtggggacattcacatgatcgagatcgaagataattgggaccccaagggatcgataggactgattgctgcggatgatgagccaaagaaaccaacagtcaaacttaacccaattgttgtgcagaaccagccctccagggacgatgaagtaaacatgtctatacctctcgaatttgaagcaccttcttctacgaaggtggccgggccaattgaggttgggtttggagttccaaaggaacctataccctttgaagttgctgtgttacccccgagggcacccattcccatagcaatgtcagacgtaacatcgttccactagaatgccataccatgggattacacagctgaagcaaggaggaaaggaaagaccaagacgggagaagcaattgatgcgcagggtatgaccagaacaggtagggtttacactccatagcacctagctgagtccagtaagcaagcctcgggacggactactgaaactggtcccgataatctttggaggaaaatacaagctaaggagtattcgatcgtggaacagttgaacaaaacaccagcacagatctccatcctagctctcctacagagctctgacacatacaaaaatgccttgatgaagatattaagcgaagcttatgtgcccagcaacataactgggggcgaaatggcaaatatggtaggacaaatactggaaagccacaaaatcaccttccacgaagatgaactatcgccgaaaggactgagtcacaacatggtcctacacatcaccgtgcaatgtgaggattacttcatcactagagtcttgatcgatgaaggctccagcctcaacatctgtccattgataactctcagaacattgggaaatagcatacacgagatcaaagatggggccatcaacgtcaaagacttcgatgggtcccaaaggtatactatcggggaaatcagcctatgcttgaaaatggggccaacctggttcgacattgactttcaagtgatagatgtcccagcatcctacaattttctgctaggacgaccatggatctatgccgctggagctgtagcatagaccctgcatcaggcagtgaagttcgaatggaatcaccaagaggtgatcattcatggcgatggtagcaaccccatatatagtcgccagaccatcccgatgattggaggcagaaggagaatagtcggagaaacataccaccacattgaaagagtcaacgttgtagacaaagataaatggtgggataacaagattgaaagtatcctgaattggtgtggatacgaacctggaaagggactcggcaaaaaactctagggaatcgccaaacccatcaagctgaagaaacatggcactacatttggtttggggtatgagtacacttgggaggagttcaatcactggttgccaccatggcgcggtccctactacccactggagcacccgatacctcacctggatctgactttccagccgatagatactatatatgggttggaggaagatgaagcattgacagccatgaagaatctgttcctggaggatgatgatatagattgcggtgttattttcgaggaggaaggcccttctatacaagttgtgaaccgaggagagagcctcaacaattggtcaatcagaaccaccagggcccggaaagcttcggggtagcaaggctaaacaaaagcaccatgcatcatattttactttttactagctgattttatttccgcattgtctttaattctgaaaagagctctgatactcaaaacaattatgaatctaattgaagcatttcagtttattatatatctcgatcttaatatttttctatcattcattttattttacacaacattactattacttgccttgatgatgaaccaacgattgtgacttgtaacgagacaacgcaacaaatggatacagactcagaagaggatgatataccagaagaggtcgttagaggagttgagaattttgaaaatagtcctaattctaacttggatgaaactgaggtcgttaatctgggagatgcagagaatgtcaaagaaatgcgcatcagtgttcaccggtcaccatcagaaaagaaagagtacaaggagttcctaaaggaatatgaagacatattcgcctggtcatatgatgatatgactggtctcagcacatccattatagctcacaaactgccaacagatccaacatgcccgccggtaaagcagaagctcaggaaattcaaacccgacatgagtttgaaaatcaaagaagaggttaccaagcaagtcaaagccaaggttctcagggtagtagagtattcaacatggttagccaacatcgtgccagtgccaaaaaaggatgggaaagttagagtttgtgttgactaccgggatcttaatcaggccagccccaaagacgacttccccttgcctaacatacacatttgtatcgacaactgcgccaagcatgagttgcagtcttttgttgattgtttcgctgggtatcatcagatatggatggatgaggaagatgcagagaaaacagctttcatcacgccgtggggaatgtactgttacaaaatgatgccattcggtttgaagaacgctggcgccacctacatgagagacatgactaccatctttcatgacatgaaacacaaggagatcgaggtatatgtggatgacatcatcataaaatccaagaaagccagggatcaaatggcagatctaagaaagttcttcaacagactgagaaggtacaatctgaaactaaatcctgccaagtgtgcattcggggttcctgctggaaaattattgggtttcattgtgagtcgtcaaggaatagaattggatccatcaaagttcaaaactatccaagaattaccgccgccaaagaacaagaaggacgtgatgagtttcctgggaaaactcatctatatcagccggttcatagctcaatccacggttatttgtgtacctatcttccaaatgttgaagaaggacgctgctaccaaatggactgatgattgtcagaaagcttttgacagaatcaaggaatacctatcaacgctgccggtcttggttcctccttagccaggaagacccctattgctttaccttatggtatcagatagagcattcggttgtgttttaggacaacatgataaaacagggagaaaggagcaagccatttactatcttagtaagaagtttacaccgtacgaggcccggtattctcttttagaacgcacttgttgtgctcggacttgggtcgcgcaaaagttgaggcattagttttgtgcttacactacttatctcacatccagaatggaccctctgaagtatatcttccagaagcccatgcccactggcaagctcgccaagtggcagatcctgctaagtgaattcgataatgtttacgtgacctagaaagcaatcaatgggcaagccttggcggaccatctcgccgagaatcccgtagatggagaatacgagcccctaaaaacgtattttcccgatgaagaggtatctttcataggagaagatattgcagaatcctatgatggttggaggttgtttttcggcggagctacaaatttcaaaggagttggcataggagcagtcttagtatcaaaaaccggccaacactacccggtatccgccaagctcaggttcccttgcaccaataatatggccgaatatgaagcttgcatcttggggctcaaaatagctattgacataaacgttcatgaattgctagtgatcggggattcagacttgctcatacatcaggttcgaggagagtgggcgaccaagaactctaagatacttccctacttgcatcatatacaggggttgaggaaaaggttcacaaagacagaatttcagcacgtccccagagtccagaacgagttagctgatgcattagctactttatcgtccatgatccagcatccagataaaaatttcattgatcccatcccagtaaagattcatgatcagccagcttattgtgcccacgttgaggaagaagcagatggaaaaccatggttccatgatatcaaggagtacttggcaataggggaatatccaggacttaccaacactacttagaagcgtacacttcgtagtctatccagcaacttctttcacagtggaggaatcctgtataggaggactcccgatttgggtctactaaggtgtgtcgaaacaaaagaagcatccaggctattggacgaggtgcatgcagggacctgcgggccacacatgaatggttgtcttagaaaaaacgatactccgagcagggtatttctggatgactatggaaacagagtgtatccactatgttcgcaaatgccatcgctgtcagatacatgcagatatgataaaggcgcctccaaaggagcttactgtgacaagctcaccatggccattcgccgcttagggaatggatgttatcggacctatcaagcctgccgcataaatgggcacaggttcatcctagtggcaatcgattattttaccaaatgggtcgaagcagcatcatacacggcggtcactaagaaggttgtggcgggtttcgtccgtgaccgcattgtttgtcagttcggggttccggaatcaatcatcactgataatggatccaatctcaacagcgacttgatgaaaccaatgagtgaaactttcaagatcaaacacaagaactccacagcctacaggcctcagatgaatggagctgtggaagcagccaacaagaatatcaagaagatactaaggaagatggtcgaaagtcacaaacaatggcatgagaagttatcatttgccttattgggataccgcactacagtctgcacatcgactggagcaactccctacatgctggtttatggtatataggcggtcatccccgccgaggtagaaatcccctccttaaggatcatacaagaagtagaattggatgatgcagaatgggtaaaaggtcactacgagtagttagcccttatagatgggaaaaggatgaatgcggtttgccacggtcagttgtatcagaacagaatgtccagagccttcaacaaaagggttaagccaaggaagtttacaccggggcaactggtgttgaggaaaatcttcccacatatagatgaagccaaaaggaaattctctcctaattggcagagtccgtacatggttcaccgagttctaactggaggagcccttattcttgcggagatggatggagaagtctggccgaagccaatcaattcagatgcagtgaaacgatattatgtgtaaccacttatgattcccttaatgatgtaatttgaactacgcgacctgattcctgtttaagaggggatacgtaggcagccctatgggttcgatcataatttaataaaaattccatttttcccccgctattggagctggggcagaattttgaggagggccctcaaaattccgaagttaattttagttcatgcatcgccagaagcgccagcccagcaaaccggggcagaattttgaggagaaccctcaaaattccaaatatgtttttagtcatttagcacagccgtcagaaacgtctgctcagcaaactggggcagaattttgaggaggaccctcaaaattccggagaaaagaggttgcaatgtcctgaaccacggcgcagtcgttgattcatctaaagaaaactattttcgattatatacgttatatttgctaaatcatggataattattatctgaattgctgttgtttagcgacgctaccccaatgacacacaacgtcaagagcccggggaagacgaactaacctttcccctcacagaactcatgattttctttggatgcaggcactcgacttgcaatatcgtcaggtatatttatgtacgcatactttcccaagaatgcaacttctcagaatcatcacttgcccgcaattgctatccgtacctaatctccccagcagtcatattgtcgtaatcggctatcaactaagagatcttactactgatcatccttttacattcttgcactgcataagactacttttctaccttccaaggttaagctctacctccatctgcattttgcataaggctacttttctgccttccgaggttaagctctacctccacctgtatttttcataaggctacttttctgccttccgagactaagctctgtctccattcgcatttcctgcatttcataaggctacctctctgcctttcgagactaagctctatctccatccgcatttcctgcatttttgcataaggctacctttctgcctttcgaaggttaagctctacctccatccgcatatctttgcattgcataaggctacttatctgcctttcgagactaagctctgtctccatccgcatttcctgcattttgcttaaggctacctttctgcctttcgaggttaagctctacctccatccgcatatctttgcattgcataaggctacttatctgccttttgagactaatcattgtatccatctgcatttttgcataaggctacctatctgccttccgaggttaaactctacctccatcctgcataaggctacttatctgcctttcgagactaagcattgtctccatctatattttgcataaggctacctatctgcctttcgaggttaagctctacctccatcatgcataaggctacttatctgcctttcgagactaagctctgtctccatcctgcatggctgaaatatcgccactttattttgaatggctgcaatatcaccatctgcatttaaattttcgctctggctgaaagatcgccactctttgcattcatttggctgaaagattaccaccttttcatgggctgaatgatcgccaacttattcaaaggcgtcatagttcggaggcaccatctgcatagcccgagaacaccatttcatgcccgcgattttttttatgctcctcatggcccaggacatcatagtctgaggacgtcatcctaaccgtccaaagacaacattcatggtccaatgggaacttgcatcatgtttaaattatgcataatacacgctacattgctcacttgcaggtacaccggctagcaaacaaccatctcagtaggagcgatcccgctccggttctccgcagtctgtccgactccaaatctaatcatcacgttcgttcttttcgaatccccattcgacacactccgtcaatggtttctgaactacatatgacctgattccgataaaaccagggatatgtaggaggctccaaatccagatctcggtcaaaacgcttttcaatcgccgatccggtcaaaattagccatcttgtctttacccgacaactctttcatcctcctcgggtaaagaggggcagctgttgatatccaatttttccctatgtatttttgtgcccaaaacacttccaaaataacatatatgtgcatatataagcgcaccaaaaggttttggcgttttaatgatttttaaaccaatttatggcctatttttacaccataaaatccaataattattcccaaagctttccattttggagaataatttattgtattctcatacttacgccaaaatatatccatcatgatttttgcacattttttacaaattcgtttggtatttttaaagccaaattgcatataattgcaatactagcctttaagatttaatagcattttataattacaaaattgatctcactatttttaaattaatatttatatattattagttgatttagtacctttaatttgcttttataacagttttactatttttataaaataataaaaggaaaaattggctatttcaattgtagcctcaattcatttcaattataacccaaattccatttcaatttcagcctgaaatcagcccaatttcgaactcaattggaccaacccaatttattcaaacccagccccttgacccattttatccaacccgcccggaaatccttttaatccaggccgttgagcattttgatcaacgaccttttcctttttaattctaccacccccaaccctgaccctcatttctcttagacagccacctctgaaacctcttctctctcaaaacgctctcaagcactcgaaaccctaatcgccaccctcgtcttctctgaccattatctcgccggagtccatggcttttcaggccatggacgacctgtgctcaccttccttcactcctaagccatgggtgttcgacatttcgaggtttcacctcaatgacgttcattcagatcttctcagatctgtggttctatggcctttccggccttgctccgacgtattcgagctttagaatcctagccatggccatctctgactcaagaccagacctcttccaagccttctcatatctagggtttcagagaaaccctaaagctattcgaggttccttcctcttttatttacttagatctgtgatgcatccgtgctatattcaacgttttaaagcttttccccaattttcttttcaaaatttgttcgctttcaatttagggttttcgaaaaaatctcaaaataacttctgactcttcttcttcttcttttctttgtgtgaatctgtctgtaccacgttcttatgagtttttctcttgagtttttatgttttccatacgatgcatgttcttctatttttgtgttctgttcttccctctactgggttctataagcatgctttacatgtctatctcgtatgttcctctactgtatgttttactgagatttttctccttgcttacctttactggactttgtttgaaccctaagcatgttttatctactattttcctaaacccgtatcgctttttcttttctgaatttgtttgagtgacaagctttgcctaaatgtattccctgtgtttcaaacttgttgttctctctgtttgtttctcataagtctctgaaagagactactgagcttgttctatttgttgttttctcatctatgcatttgattcgagtcagaaaccctagtatttggggttttttggcaagcttgactttgtgtttggactagggttccattcagaaccctgactctctttcagactcattctgagtctgtgaacctaaccttcttgggtactctaatttcttgctagttttacatcaactctctcttgtctcacatgtctgtatgctttttatatgacaaattctattctttcaaaaggcctttggccagcttgtgattgattctgagttccttttttaaaatgtttgattgtgtgttgttgattttctttaaattaaacccttctcacctttttctggttggattcattcacactaagattcgaatcctgattttacgggcaggttgattgattgtctttccttgtttgacctaaaccgtgtactactaaactgtttccttaaataggtttatgtgtctttgcccctattatactgcctcagaaaatattgtttaaaacaattcctttccttatttatttttcctatttgaatcaaatcccttaaccaaagggaaataacttgtgattgatttcaaaactattctcttaccttttgatttactcaccttctgcaagagtaaaagggactgctcttttgcactaaagaaagggttttacagatgctttcacagacttttctgcacaaaacacaggcttttacacattcgaatactgagttctttcacaaaaaaaaaattctactctcttcttctactttgtgctttctgaaacaattttgagctctctctctaaactctcaagtgttctgctgaacttaagtctgctcctgctgtgtttacttgccgtgattgctctattgttcttcttgttcttgctttgcaactggtacgttattcttagttgaataatgcttcttcattatgtgtttacttcctagtctgttatgttcttttttactatatttctgcaaccctgttgtgcttttcttatgtgaactccctttcccttttcccctttgtatgtgagtatagttccggccataacaacactttgatattgctgtctatgactctgaactgggttctttgaacctcctaaatcaaacaattcccactcccttctcccctttatgtgcttgagcctggacctgagtctagtggtgtcctaatcaccatccagacctaggtttgagcctcaagggtctgctcctaacttgtttgatcaaacaaatggtcaggggtgtgccagtctgcacctgtggctgggtatgcccaccatttgttatggctccccaattccttttcactttgcacttactcctagctctaagttctgcccctctcttgcaagccatgctttgggacccttgagctcccactgaacttggatgcctgaggcctagctattccgtactgcactattctaattataaatggtatcctgagtgtaagcaatgccgagaatccttgagattccttggaactttgaaacactttggataaagagaaggctttggaaatccgaaattggttaatcacatgttattggacattaagattgaattaggctgctcggatctagctgttagtttttaatgtatttattttctttcttttggtctgtaataatttgtataaagaatttggggaatatagtaaaagggtgtgggaggggttttacattcttgcatcagtaagggtagaaaccatgctttaggattttaatgtttttttagaaatcctgcctataggattgttcaatgtttctgattccacatcacttagagaccatgcctatagggtcaatgcttcattgtgctacaaatcacatagaaatcatgcatataggacttaacgtttatgtaatcaatgcatatagagatcatgcctataaggaatgcatatgcatcaggcaaactgtagggttaattaacacaatcatcttttacaagttcaataacaggttttaaaagtcaaaatagatatcatgcctataggatttgcatcaaactcatctgattcgcttaaagtaataatgatctattaactggtccttaacgtcttaatacaacaacgatttcataagtcttaattctttgacaaaaactctcttgactcagtatgcttttaagtccctcaaatcgacatctttttctgaaacagtttctttctaaacgttctgcctaaatgttttactcagaccctgaaattgtcttttaaaatagttgcaacttaccctttccttagatatttctatctctgaaactctttcacaaccatttctgtgttttatttttattgcagtctatactttcttttcaaaactcctctacattagactactttttcctgaaaccagtaccttttaaatcactcgcttgcaataccttaatttctgacaattggatccaagtttcctaatgcagactttctatctaaacaaatgggttgaaccagttcgttcgctgtttaagtttaatttaaagaccaaatcagtatgtgccaagacatgctaaactaagtgtttgtttgattaaggggtttacttgagccttacctatttgttttgttcatccttatatttgttacttgttttgtatgtcgcaattagaattttaacctttgaactccatatatgcctatatccctttccttcccctttaggattagaagtcctgataccccaggactgataggttaggacgagtactagcatgcaataagtaaatgagactgatcgcgtttaaataccttaacgaggtgggaagggtagaatatggatatgatgaccgatgcgctaatatcacgtgcgacccctcttctgaggagtgatcgctaagtattgcattgaattgatccatattaattataaacttaggactcccctccctttattttctttcatctcttcttgtaaaactgttcaaatctctttttcatgaatttctgccctctctacttacctccaaaaattttcaacttggtcgcaatgttatgtgagaatccttatttgagccttgactatttacttgtaaagtcacaattgtaacatggccgggaaccacactagtggatcttgaggggtgcctaacaccttcccctcgggataatttctagcccttaccctaatctctggtctcttcatctcaaacccttcttaaagtgtcctaatgcactataatcattaggtggctactcttcaacctctaaactcaattctcgaaaggggatagagttgtcctcccaatgtcgtatacccaatttctgaccccgcggttagagaaaaagagggtgtcgacagcatttgcgaaggcaacctcacaaatgcgaagctggactgcatgagaagcattcgcatttgcgaagaatttttcacttttgcaaaggaccagtgctcgcatttgcgaccagtttggtcgcatttgcgaaggcagcagagattccaaatcttcgcatttgcgataagttgttcatatttgtgaacctcatggtgcaaatgcgacatctgcagcctgttaagtgttgagaattccgagacttagcttcattttcatatattttgaaccctagcttcgatgagaggcaattttgtgaagggattttcatatcaaatcattgggtaagtgcctctaaataatttccaactatatttcatgattttacataaaatataacatcaaattcgtgagaaatctaggggaaaatttgggaattttgtcaaagttttaaacaataaaaatttggaatttgagagtcgaatagaactcggatttgaaaataaaacatatatttggactcgtgaggccatgggtagtcaagatctacccttggacctgagttttgaccaggcgggcccgaggtttgactttttagaaattgaataaaaatcacagctttattaatcaaaattattttctcttgcattgtgtgatgtattcaaatcgtcgttggctagattgagttgagcggaggtgaatttatagaggaaaatgctaaattaagtgttgagttagccgaattgaggtaagtgttttgtctaacttatttgagggaattgtttctcctatttgtcattgtttgcttcaagcggggatgatacatatatgaggtgacgagcatatatgtatatgccaggattaatcaagctcgggaggtggattatgttacacttgtggttgtagaccttcctgcttcatgccttacttgactcttagatactaagaacatagtattaaatgttagaaatcaagagttatcttattataacttgatcaaatttgatggaaaatctcagcatacattgacttgtctaattcagtcacctatatgtgtaatcattactacattactatggccgatattcttgagatactagactctatacaattaagttgtggatcatttgtgagatttgtggaagtatatgattattgaggattgttgaatcattgttgactcggaaagttgtgattgagatttgtttgatatacccgttaaaatactctccttgatgttatttatgcttcctgcctgtttgtctttgaaatccatatgccttgtacggaagagtgtaaagcacgaagggtgatgtcataacactgtttatacattatcatgtgaggaagagtgtaaagtacaaagggtgataccgtgccacgttattgagattaaaagcccaaagggtgatgccgtgccacattattgagagtaaaagtacgaagggtgatgtccttccacaatattgggagtaaaggcacgaagggtgatgccatgccgtttcatttatattgttatactttatgttttcttgaggtcatggcacgataagtgtttccgtgcaggcgaggatgaggggcatgcattatgtttgatatcactctacgtgtatacattcatgtttttaccttgaactgttattgttataattatagatctgatgtaacttgttactattgttctgtcattgagctctatctcaattgttgttgtgttgctcatatcttctacttgcttaaattgcaaataccatgcctatttcctgcttttataattatactcatgtcgtatctattttgttgcactttagtataaaccttccaccatgctagtcattcacacccttacttgttaacttgtaaagatcatgtgtctccttcttaattgttatatttgcacttaggcctccattatgcttgttaattggagataatattccttattttccaattattgttattactcacatgcttccgcctagacttttgttgttgctcacatgtatatccttgtccattattgctacttgcatatttcctactttgtaattcttgttatcggtatttctgtcatcttgttggttctgttatacgtacatttggaaggataagttgaacgcacgaagggttttaccgtgccatttgacatgaaatcttggatatactcctcataccagtaaagattgaaattcttctactgtgattccttctagtaattgttgactgtctcgcgcagtggtatatgatacacttatctattatgttttgaactgcctatattgttagtctaatatacagcttataacaataagcatcttttaattaaaagcctcgtcactaattcaataaggttagacaaaatatttaccagtacatggggtcggttgtactgacactacacttttgtacgttatgtacagacttttggagcagagctgctggtgatgtcgagtacttactctaaagttgttcgtgcattccggatatagctgccacttgttcttggtagcttaggttttgctaatatctttacgtaattatgtattagtttatcaaattccatgtcttaaaagctcatgagtcgtactaccagttcttgggtaaatttgtaaatgttcagataaatctttgctatttcctataatctcttttggactatattttttgttagtagacttacctagcagatcgagttaggtgctatcacgaccagttattttttttttctgatcgtgacaaggtggtatcagagcactaggttcgtaggttctacaagtaatgagcaagtgtctagtagagtcctgcagatcggtatgatgacgtccatacctatcttcgggagattactgggaatttaggaaaaatttccctttcttatttccttatcatgcgaccttgttttagcttgaaatgtacaactttgactcctctcaatcacttatatgtgaggttgtgcaatcagtattcattatatgtcgacgattggtgatgctgtagatagattacaacgagttatgcatgcttgtttatcattgcgatatgttgtctagcctaaaaaacagagggggtgttaaatcatccagtcgttcattcatggtatgaggttggttcatatgactggttggcatgtacagatttgggaagattgactggtggcctagctattgtgattaaggtgggttcatggcaaggtgtcgatttgagtataaccggtgggccatctcctgcatgatgagtttggatcgtgtgtctcgtatgaggtttccattcagtggagtgcaagtgttattatttcaaagcatttggcggaatttgtttgactattgcaataatgggtaagagcttgacagagtcttcggggtgttctatgattagtattgcatgaatttttgaagtattcaactaaatagtcgtgcgggatcggggcatgctgtgaagattactttgaggtgctgatgaggtattctatttctctgagttaagtggtggagtctgctaaagacaatcggattgtaggatcatgggccgtatcagtttttggaccgagagattgcttggttattcctttaaatgggcatatactggtgaaacacgggtttttcgatgcgtattagctatgtattgaagatcagagtaagatgagtgattatcgagaaggttctggtaagttccaggtcttatgtagcctttaaggacttttgaatttttctatgggcaggcttgaaattggtagcgaatggtaatcggatctgcagtatttccttgtcaagaaaggtctacatgttaatattgaactgatgtaagaaatggcttcgggttcccaagaagttcccccagggaggtcatgtcagattgagttactttcgggttggcagtctatgtgactcggttgagttagaggtgactggttctgattactcgattatgtgttaccgagtttcgaagaatttatcatggttatgaccaaagtcggagttgatgttttctacaggtatagaagctatattgctataagatgttcatagtgttgcaagtaatcatgttagagacgatgcaccgtgtagggttgaaaagttgcatgtacaaggttgcagttaattttggagggaaggatatgagttcttcatgatacggacgatttcgggtatttaaggttttgctggcactatctgttcctaccggaggagagttctattgttggcaggtacattgtgttttgacttataagtatttttcgtacgatgatgtagtatgagtcacgtgtcagccatttgtgtagcgatgttgaaatttaggtatgaagattctggtattcgtaaggtttagaggctggataatctcgttggcaaactattcttggattgcgagctgtgaagaaatgttgaggaccggatgattgatagtaagtgttattggaaggatgccatggattttggaaggttaatttcatgtttggggatgatgggaatttggtttgggggttgcttttgagcctaatgagaatgtgtattccgtatctaattggatttgtttgttcttgcgtagttgttaccacatgtatatcatcgggcggaatggatgttattcgcaccttggtttatgttatatgtttctctcttatactatgatgggttgtgagggttacatgattctttacacgaatattgtgattcagtttaggcctcatggcactatgggcgaggtggccttcgtgatgttgatttgctaattgcaccataattgtgcttgtccttctcagtattgtttgtttctaataattttctcacagttatattttctgcactttgttgtgcttgatgttgatgcacatgtggtcaataagcccgatgttttatggcttgttgggtaccctatgtggattgatatgatgggatcgggttgcacaccacaacagtacagtgatcaaatgtgactccttattcctatttcgtgtattttgctttcaccttgttgaagatagttcacagtaaaatgctaacatttccctgcctgcttaacttgcttagtagccttcttatttagttttcttactattatctatcatgtctgaattattacttgttagtacatggaatcgggttgtgtggggctttatatgatcattgttggtacttgtcgatgaggctgcttgtattggctgagatgaggtttctagacctaagattttgcgctattgtattgagatgaggaaggtttggaagaataacactatattttgtcgaggatttggacaatagccctggtcgggcgagtgagtttcttggcttattgatcagatgattggttaagcggttatgtgtgtttctttcatcatcgatggggtatgaaggttttgaatgaggttctaattaatatgaggtttgctaccggcaccagatttgtttttgggcagtaattgtggttagaagttcctaatgtgagtgtcgaagtgatgaggtatatcatgtgactacatcttgggttaaggttatgatttgatacaacttgttcagacatatacagtgtgtaactttgggattcgggtcttgtaatgtattttggatgatagagattgggttctatggttttaggactaaggttgaaataaggatctctaatggtgttatgttggctagcttatgtggaacaacatgacatgggatcacctcaggttgatgcttagtaagttacaccaggatttgatagctttggaacgactcctggcacgttcgaggatgaacgtatgtttaagtggtggaggatgtaacgacctgacttgtcgttttgagtatctgcactacgatccatattttgaggctcatgtatctcctcatgatatattatgacatgcgtaaatcgtcggtattggttttcaagttatccggaatcgatttggaagaatgaacttcaagatttaagttctaaattggaagaattgaccaagtttgactttttagtatttgacctcgaaatggagtttcgttagtttcgttagctccgttgggtgactttggacttagaagtatgtccgaattgtaatttggaggtcagtagttgaattagtcttgaaatggcgaaagttggatttttgaccgggagtggaatttttgatatttggggtcagatatcaatttaaaaagttggtataggtccgtaaaggcaaatgtgacttgtgcgcaaaatttgaggccaatcggacatagaagttgaagtttcaaatttcattgattttgacttgaggcgtgattcatcatttcaaggttgatatgcgtgatttgaagcttcgggtaggttcgttttttcatatagaacttgtttgcaaaatttagctctattcgtagttgatttgatatgtttcggatgctcggttgcgattctagaagttcttgaagtttaaattaatcttcatgcattttagcgtccgattcgtggttttagaggttattttgatgttttgatcgcgcgagcgagtttgtatgatatttttagacttgtgtgcatatttggtttagagtcctgagggctcgggtgagtttcagattggtttcagaatgatttttcataatatttgattgctggttttggttttgtcgcatttgcgatgtgttggtcacaaatgcggccatcgcatttgcgaaggcaacctcgcaattgtgaagctgggctgtaggagaaggatttacatttgcgaagaattttctgcttttgcgaaggagcagtgctcacatttgcgaaggcaacagagattctcaatcttcgcatttgcggggttgtcgtttgcgaaccccatgtcgcatatgcgacatctgcagcctgttaagtgctgagaattccgagacttagctttattttcatttagtttgaaccctagcttcaatgagaggtgattttgggaagggattttcataccaaatcattgggtaagtgcctctaatcaattttcaactatatttcatgattttatataagatttaataccatattcatgggaaatcttggaaaacttttggggattttgttaaagttttgaaaaatgaaattttgggatttgagagccgaataggactcggattgaaaacaaaacatatatttggactcgtgaggccataggtagccaagacctacccttagatcgggcggccccggggtttgacttttattgactttttagaaattacataaacatcacaactttattaatcgaaattattttctcttgcattgtgtgatgtatgcaagtcgtcattggctagattgagtcaagcagaggcgaatttgtagaggagaaggctaaattgagtgttgagttagccgaattgaaataagtgttttgcctaactttgctgagagaatttttcctcctatttgtcattgtttgctacatgtgggggtgatatatatatatatatatatatatatatatatatatatatgaggtgacgagcgtatatgtatgtgccagggttaatcaagctcgggggatggattatgctacacttgtgtttgtagaatttcgtgaccttcctgcttcatgacttacttgactcttagatactaagaacatagtattaaatgttagaaatcatgacttagcttattataacttgattaaatttgacgaagattctgagtattcattgacgtgtctaattcggtcatctctatgagaaatcattactacatttctacggtcgatattcttgagatactagactctatgtgttgtagatcatttgtgatatttgtggaagtatttgaatagtacgattcttgaggactgttgaatcactgtcgactcgaaaatttgtgattgggatttgtttggaatacccgttaaaacactctccttgatggtatttatgcttcatgcctgtttgtcattgaaattcatatgcttggcaaggaagagtgtaaagcacgatgggtgatgtcgtgtcatgttattgagagtaaaagcacgaagggtgatggcatgccatattattgagagtaaaaataggaagggtgatgccgtgccatattattgggagtaaaagtacgtagggtgatgccatgccattttatttatattgttatgcttgtatgttttcgtgaggtcatggcatgatgggtattttcatgcaggtgaggatgaggggcatgcattatgtttaatattagtcttccgtggatacgttcatgtctttaccttgaactgtcattattataattatagatttgatgtgactttttgctatttttttatcattgatctctatctcaattgttattttgttactcataccttctacttgcttaacttgtaaataccatgcctattccctgcttttatatacttatgtcgtatctattctattgcactttagtataagccttccaccatgctagtcattcatgcccttatttgttaacttgtaacgatcatgttttttatttttcttaattgttatatttgtactcattcctccattattctagttaattttttttggcaatccgctaggcaagcgcctagggctagttttttattaataaaagaaaaaccaaaatacaacaattaggaaaagtataaataagggggacaatagcaccgatattgttacccatatgccttggctatataatcacttctctgcgcctcacattgccttatgatggcagcctcatgtagaggttcatggtgtagctgccggcaacgtctcacgagggcatataatctcatagccatgtggatatttttccaaagacaaaggacaaaggcaatactaaccgtgctaaacgttaccttaccaatcctattgaggcaaagagaaagcctcatcttctagaaagcatgtaaaaaataggaacttgaaagtaccaagtactgtatgatcgccatagagtttataacacactctatgacgctattacaagtgatgatgctttgaaaatgataaactaagacaatgtagaaattagaatcttgcccctcatttatcaaacttgtgagttcttcaatttgaacgtccttaaaatcctctttaactgtcttcaaataatcttcaaagtttttcatttgttgtcgtatctattggatttcgtagatttggaggtggcaaccccttttttctttgcagctcttattgggagttgcctgagtgttatttcttgagtcactttctttttttcagttttgttagaagtgaaatctccagttgtagccgcctcttccggacaagattcaatcaagtcatcctcttttgcttcttcggagatggcaacgcgtaagttgtcctcaagtttttgattagcttcatcttgtataaccatccacaatggttcatgcctcttcagtgtctttgcactacttggttcctgtctgtttgtcattgaaaaattcagcttcagtccggtcatttttgagtatgatgagaatgcacttttgtgtggttttggactgcccaaagcatacaacaactttctgtcctccaacgaaatagcaggtatatcagttaccattactttggctccagtcatgtttgcattagattgctgctgtccagtcgtgtttgcattggactgcttctacccagtcttgttcgcattggactgctgctgcccaggattagtattaacatcagctgcaccatctgatgcaatattcacagcaaactcaacggaagctacttgcgtaactgcttcagcattgtgagatgtaccaactagtgtagctggtagttctgcattatttcgaattacagtacttaatgtactagcagccatcatctgctgatcgtcggatttcccatttgcattcaatgttttttctagaccatcctcttccttacccagttgtgcagatgtatcagctcgattataccttgagttataacctgtagcaaattcctcagtctgagcaaccatatcatttgagactgcattgataggcttaccacgattatccttcacctctttccattgtcctcctaaatttccagtaggcttttgacctgtgaagatcacaatagttcctgtagcactagccttacctttcgtcttattttgagtatgtgaagtgtcatcgaccactccctgcatttgagtcacattgtcattttcttgcagctgattggcatctcttattgcattcaacaattgccttcctgaagtagaggtccattttggttcgaaacagcagccaaattaccctgtttctctgaaacaaagtccttggcttgaaccacatcttcatcagtagcccgtttctcgttagatttgtgttccattaaatttggatatagcctccagcactctatcatatcatggccctgcaatttgcattccttgcaatattttggcacgaagtcatactggattttcaccctcagttctcgcaactccagtagcctcattctcaatgtccatacgcactctcttcggcaaatctgcttgtaggtcgacaagtacctttactctaacacagctaggccttatttcgtttatggttgccaaatccaattgttatggttttccaacagcagatgctagagaaaacaaacattctttcacaaagtacgtgggcagtaaatgtggaaatgaaatccatgccatcgccataggtgtttcttctccgactttgaaatttttatcatagatgagctgtctcatttggtattcataaccatcttttgccttaatatagtaggtgctttttgacatgattttctgaaaatcctccctcaaagttagacgaatcagtacatgtttgtctctcaacaatccgatattacaatctcctttaataccacattgtacagggattaatcgacgcaattcctggagatctggccatccgtaagagaacttacccagcacaacatactgtagaccttcaataatattcattctatccaccttcgattatgtaaacttgacaaaaggttgtccatgtaagaaagtagctggtttgaaaggaattggctcaaccgatgcatctttctcgttcatctggttgttgattgttgatggttttaacaatctgctataatctaatggttggttgtttttatttgttgctgtttttgatggatcgaagcttgttaatggctgaccagccatagatgaaggctggtcgccggccattatggccattgagctcagatcgccacttttttccgcgatgaatagtagcgggatctactgttccattcactgtttgggcactgtagcgctactattttagactgtttggaactatttgacactatttattgctacagtgacgacggattttttttaattttctatagaagactacttagaaattaggtcttaatttttcaattccccctagccagattggttattagagagtattattctagttaattggagatgatattcattgtttttcaattgtttttattactcatgtgcttttcacctagtcttttaccgttgcccacatgtatatcctcgtccattgttgctatttgcgtatttctactttgtaatttctgttatcagtatttctgtcatctggttggttctgttatacgtacatttggaaggataagttgaacgcacaaagggtatttccgtgctaattgatttgaaatataaattatttatatatggtgagggagatatagaagcacgaagagtgttaccgtgccatttgacatgaaatcttggatatactcctcataccaggaaagattgaaattcttctactatgattccttctagtctaatgtacaggatataacaataagcatcttttaactaaatcctcatcactacttcgacgagattagacaaaatacttaccagtatacggggtcggttgtactgacattacacttatgtaacttgtttacaaacttttggagcagagctgctggtgatgtcgggtgctgactttgaagatgttcgtacattccggatatagctgccatttgttcttgaaagcttatgttttgctaatctgtttatgtaattttcaaatagaacgtgtaactatttgtatccgttttgcaaatttcaagtcttagaagctcatgagtcgcagtaccagttcttgggtaaatttgtaaatgttcaaataaatctttactattttcctataatctcttttggactgtattttctaatagttggtttacctagcggatcgagttaggtatcatcatgaccagtgcttctttttgggtcatgacaatttttttgtaaatagccatcaacgacacacgaaaaattctaaggccctaaggaaaagccaacttcaacagcatacatgagataactcaacagagaatctattttagaagcttattaaagtattttgacacccaaagagcatctaaaattataaaatttcataacagacaattgtttatttggggttttccttatcaagagatatagatacatttgtgtctgttaaaagagaaaagtattttatccactttacgacaattatgaaacaaaactttagactaatttattagttggaataaatgcaggggacttcggctgaatttgttagagtttataaatccaagtgtgaaatttattaaaatacttataatcatataactatttctaaatcaagtgtcatgcatcgagaatttatcaacagaaagaacagtcgttttaactttaacaaccattttaagcttcaataaaatctatttttataaacaacttgctatgtttaacaataatagataaaaaaatatttatctattatgtaactggagaatccatcaacataatacctagtagaaaagatcattaaacttaatccaattacaattatcaagtcaacactattgaatattaacccatatttaatcagagtaattcaatataataaagtaatacataaattctttagaataataaagaactaaacatcatctctcaaataaataagtaaaagtttaacattacttgaggataaacaaatatgcatataaggcttctaaatattttacagtaataaatcttcatcaccagtttcaggttctgattcgatgccttcaataatataatcatctaaggtaacattagtgctgataacatcaagatcatttcttccccagttcataaagtcttcatcttcctcaaacgtacacgagaactcttgagcattttgttgaaaaatttcttcactgacaacaccaccagtaaaataagtagaatgaccattcaagacaatggaccaattgggatgaagattaaccttgacataaaaaacttgttctgcttgagatgcaagcacaaatgattcatttgttgctagctttcggttagtattgatattaacaaaaccatattatctatcttcacaccttttccaatgttatcaacatccaatcactcatatttaaataaaataatcttttaccttcgagatattgaagttctactatttcggtcagagtaccataataatttatattttgaccgttcattatttctcgtactaaaacaccactattctacttcaccatgtttccttcaatttgtttaatataaaatctaaaaccatttatctcataccctttgaatttttggaatccatcaaaaggacttctagccaaagaacccgcaacttacatgtgaatttcctttcttatgcatttgcacaatctgtacaataataaataaacaaaataatgatgctaaaaggtattacaaataaaaattaacaatgtaatgaaaacttactcgatggaaaaaccaagcgccgaagttcatgttcctattgttctgctcgtactcactatttaaaataaccataataattgaaaaaaggctagtaaaatcaagtagaaatgtgcaatggcataaagaaacatactgtaaaaatggttgaacttcttcacaatttctcaaaacttaaagatgagcttgttttcgctcaagctcttcaagatttctagatataactcttaataaagggcaacccttttgttcaaaaataataatccactgaatgtatcaacttgatcaccttcataatttttgtctactggattattctctttcccacttctgtgtaaataccttgtacaaaatatcagactttcttcaacaatatatccttctacaatagatctttcaagtcaacatctattacgaacataatattttaatttgcgcaagaatctacatgataataataggtagttaaacgcttagcatgataaattaataaaccacaaaagttaaattgaaattatgaaatacaaaaacataccactctattgggtacatccaccagtatattacaggtccagcaatcttagtacaaacataccgctcaatttgcctcttggtttattgttaatatttttttaaaaataaattttcctcttatctgggggtgttttattaatcaaaagctggttctcattagtacaacacaagggcccttcaaaatatctggcgaggtgataatataatacaagtttacctgccaccacaaccaacaatatatttgattccaatacttggtatttgacttttgtataggagaaagggcccttagaacccttgggaagttgctgactggagaagtcgtaagtttcagtccgagattttgcagccaatttatttaaacaatcagcgagttagttggcttctctatagcaatgattgatatgtatatttgtcttataccttatatgtatcatcttatcagtgatatgatccatcctataattagtctctttttccacccttaaaatatcagctagcaagagtgaatccatctctaaagggaaagttgtatgtaacgatccggcgggtcgttttgaaaattaatgccccgatcccctattaactgcttcccccgtatcattttcttctattgtgatttgccgggatggttcatcttgagtttcagagtattttgggacacttagtccctaaataagagtttaagtcttagaatttggagtgtaatcgaagcagtatgaaaatggctccagaatggaattccatcaattctgttagcttcgttctttgatttcaggcttaggggcgtgtctggattgtgttttggaggtccgtcgcttatttaagcttgaaatggagaaatttaaatttttagagtttcaagccgataatggaattcattaagtgcaaaatgtagggttaatcggacatggtttggttggtttcggcatcaattgtagaattttaagatttcaaattcattaagtttggattagagggtaatttttagttttagcgttgtttgatgtgatttgagagctcgactaagttcgtatgatgtttaaggattggttggtatgtttggttgaggtcttgggggcctcgagtgagtttcagatgcttaacggattgaattgggatttagatattctgctgaagattgttggaccagttgttttcgcacttgcgaattttggaccacaggtgcagtgccgcagaacggctgggacgccgtagaagcggaaagggacctatgcagctgagactgcaagtgcggctaggggactacagaagtgggactgcagatgcggcctggtgaccacaaatgtggacccagctcggataagtgaccttcgcacctgtgatgatttttccgcaagtacagaaccgcagatgcggccccatgagcgcagatgcgaaaatagctgagcagaaaagaggatttcgagggtttgaaatttcttaatacaaaacttgttttggagctcggtgggaggcgattcctcaatggaatttgaaggaaatctattgggtgactaatcctaactctagtttggtcataatacattaatcaattgttgtatttctcgtctaactaaggaatttgagggtagaagtttggacatgggggaaaaagctccccaattgaaaatatgaggtttgaatgggaattagacatcgaatttggatgatttttgtacgagtgaactcataagtgaatgagtgtccgtaatttgtgacttttacccgattccgagacgtgggcccggggaggatttttgggtgttttcctattttcttcttttagttttgaatttattagctaaattagttgcgtgtagctatatttatgttatgtaattgatttcattagatttgggcccctcggagttggatatttatggcaagagcgtgatttcagattgattttgagcttggttcgagataaatgacttgcctaaccttgtgtgggggaactccccttaggatttggtactgttgttatataaatacggtgtacgtgaggtgacgagtgtgtacacgggctatttgtaggaaattcccattttcattaagtaaatatctatgtttcccttaaatatattaataccagtacatatagtcatcctatttagttatgaaagtatgcctacgtgccttaactgttttaactgctttaactaactacttgaactttgtgaagcatgtttagagtaagaattacctgtctttttttcatatggacttaattagaattgtagattttccttgttgaaactgttgtttatattgaatgagttgtgtatttattttgagactacgaaacggtattgcgggagatccccctgcactggatatttattttggtactacggaatggtattccgggagatcctcctgctcatttatgatttggtctatgggatggtatcccgaaagatcctctgtacatttacgtttgggcctacgggacggtatcccgggagatcccctgttgctatctctatgtattaaattgatgttttctatgatttcatttttcattgactgttagtattcatatttactgcaatatttcatattgttttaccttattatttatataagccagtagggccctgatatgatctcgtcactactcgactgatgttaggcttggcatttactaggtatcgctgtggtgtactcatgccctttcctgtacatgtctttcatgtgcagatccatgtacctcttcccagccatattttcagtgaggcgaggcgatcttagaggcttcgaggtatatctgccacatccgcagatctagaagtccctctttactcttcctcaagttatagacttcctgtattttctttgttgatagattttctagagtttagaaacactatgtacttctatagcttgtgattcatgagtttttgggttttgagagtgcttaagttcagttcgagagtgttttattgtatatgctgagcgacattttaaacgtttttactagatttacctgttaaattgttagctttcatatttttcattctatttccgcaaattgttaggcttacctagttgtagagactaggtgccatcacgacagttcacagagagagaacttgggtcgtgacaagttggtatcaaagctctaggttcataggagtcgtgagtcacaagatggtttattaaagtctcacggatcggtatggagacatgtgtacttatcttcgagaagctatggaactattaggaaaattccaagcttccacagaggagccaccggcagctctatccggagcccatgcacctgatacgcctactactactactacttcagctctctataagacccctgcacagttcatgagcatgtacaacactctagctcagacatggttgattccccttgctgcagccacatctcaggccaggagaggagcatagactcctgccgctcgcactccagagcaacgggttaacattgatgagatcctggaggttataccggtaccaattgtagtcccaactcatcccgggagaagggcaacagtttcagaggagaaatagcggaggcttgagaggtataaaaagtacgaccctcctacattcagtggtctagtatcagaggatgatcagggatttttggaggagtgccaccgtatcctccgcactatgggtataacagagtcgagtggggtttctttcactaccttccagatttgaggggcagcctatcagtggtggcatacctttgagttggacagtccggctgaggcagcttcccttacatggacccagctttcggatatgtttttgagggagcatgtccctcaaagcctcagtgacacatgtcgcgcgaagtttgagcatttgtgctagggtactatgattgtttcagagtatgctgtttgtttcggtgacttggctagacatgcactggccttggtttctacaattcgtgagagagttcaccggtttattgaggggctcattcccagcatcaggtctagcatggcccgggagttagagatagatatcacttattagtaagtggtaagtattgctaggagagtagagagcatgcttgctcgagatagggaggagagagaggccaagaaatatcaagagtcgggccattattctggtgcccatgccccagctgcagctcatcatggtataggctatgtgagtcgcctcgttcattcatctcttccagcagtcagtggtaatctagctcctcctagaccttagaagccttattatgcacctccagtatctagtgcgcctcctgtatggggtgctttcagtggttagtctagcagacctggcccaagccaagcacaaccaccacatcctcccggagctttttttagtgtggtaacacacgccatatggtgagggatttccctaaacttaggaggggtgtacctctatagacttcttagccacaacatgctccacagggttccgaggctatgattacagcactagttgctaccccacctgctcaactaactagaggtggaggtcggggaggtagaggtcaccctagagggggaggccaggctagatactatgctcttcttgcctgtacagaggttgttgcttctgattatatcattacaggtattgttctggtctgtcatagagatgcatcagttgtattcgatacaggctccacttattcctatgtgtcctcttattgcccgcatttgggcgtatctcgggattctttgagttcccctatttatatttctactcctgtgggagattctcttgttgtgtaccatgtttatcggtcgtgtttgattgctcttagtggctttaagaccagagccgatttattattgctctgcatagaagaatttgatgttatattgggcatgagttggttgtcaccccattatactattcttgattatcacgctaagagcgtgacactggttatgctaggtgtaccgcgattagagtgcaggagtactttagattacactccagtagagttattttatttcttaaagctcagcgaatggttgagaaggggtagaacgcgtatctagcttatgtgagagatatcagtattgatacccctacagttaattcagtcccagtagtgcgggatttccttgatatgtttctagttgatcttccgggcatgcggcccgacagagatattaatttcggcattgatttgttgtcgggcactcaacccatctgtattcctccttatctatggctcctcctgagttgaagaagttgaaggaatagttacaggaattgctggataagggctttattcgacgcagtgtgtcaccttggggttctcctatcttgtttgtgaagaaaaaggatggttctttgtgtttgtgcattgattatcgccagttgaacaaagttacagtgaagaacctgtatcctttaccgcgtattgatgacctgattgatcagttaaagggtgctcgattgttttcaaagattaacttacgttcaggttatcatcagttgatgattcgggagctagatatctcgaatactactttcaggactaggtgtggtcattacgagttcctgattatgtcatttgggctgacaaatgccccaacaatatttatgcatctgatgcatattgtattccagccatatcttgacttgtacgtcattgaatttattgttgacattttggtataatcctggagtcgggaggatcatgagcagcacctgaggatagtgcttcagaccttgaaagaaaagaaattatatgcgaagttctcgaaatgtgagttctggttggattctatggtgttcttgggccacgtagtatcgagtgaaggaatcaaggtagatccgaagaaagtggaagtagtgcaaagttagcccagaccatcctcagctatagagatctatagttttcttggtttgactggttattaccgtcgatttgttaagggattatcatctattgcagcacctatgaccaggctgacccagatgggtgctccattcaggtggatggaagagtgtgaggtgaactttcagaagctcaaaatagctttgactacagccccagaattgatattgctcacaagttcggggtcttatactatctattgtgatgcctcgaggattgaccttggagaggtgttgatgtaggacggtaggataattgtctatgcatctaggcagctgaaggtgcatgagaagaattatcctgtccatgatctcgagttagcagcaattgtccacgccttaaagatctggtgttattatttgtatggtgttgcttgtgagatttatactgatcaccggagtttgtagcatctctaagatcactattttgtaccacccgggaaaagccaatgtggtggcctatgctttgaatcgtcgggcagagagtttgcagagtttggcttaactaccaacagtagagagacccatggtgatggatgttcaggccttagttaaccagtttgtgagattggatatttcggagcccaatcgggtcctagtcctagcttgtgcgttttctcggtcttccttgtttgattgtatccgagagcgtcattatgatgaccctcatttacttgtcctcaaggacaaggttccacatgatgatgccagagatgtgaccattggtgatgaaggggtattgaggatgcagggacggatatgtatgcccaatgttgatgggctttgggtgctgattctagaagaggcccacagttcgcgatattccatccatctaggtgccgcaaagatataccaggatttgaggcagcactattggtggatgaggataaataaagatatagttgggtttgtagctcggtgcctcaattgtcagcaggtaaaatatgagcattagagaccgggtggcttgctttagcagatagcaattccggagtggaagtgggagcggatcactatggacttcgtagttggactcccactgactttgggtagtttgatcctatttgggtgattatggatcggctgaccaatcccgcgcacttcattcctatgtgtactacctattcttcagagtggttggctgagatttatatccgagagattgttcgcctgcatggtattccagtttccatcatttcagatagaggcactcagtttacatcattgttctggacagccgtataacatgagttgggtactcgggtggaattgagaatagcatttcacccccagatggacggacagtccgagagcactattcagattcttcaggatatgctttatacgtgtatgatgaagtttggaggttcttgggattagttcttgccacttgcggagtttgcctacaacaatagttatcagtccaacattcagatggtaccatatgaggctctatatggtaggtgatgtagatcccaggtaggttggttcgagccgggcgagactagattattgggcacagacttggttcaggacactttggagaagattaaggtgattaagatagacttcgcacaacccagtccaaacaaaagagttatgcggaccagaaggttctcaatgtttcatttacggtaggagagtgggtcttgcttcgggtttcacctatgaagggcgttatgagattcggaaagaggggaaaattgagcccaaggtttattggcccctttgaggtgttgcgacgtgttgaggaggtttcttatgagcttgccttacctcccaacttggcaggagttcatccagtatttcatgtttcgatgctccggaggtatcacgatgatctgtctcacgtgttggatttcaattcagtccagttggataaggatcaatcttatgttgaggagccagtggctatattggacaggcaggttctaaagctgaggtcaaagagcattgcttctgtaaaggttcagtggcgggttcagccgatcgagtaagcgacttgggagactgagtaggatatgtgcagccgttatcctcatcttttcactacattaggtatatcactatggtcgtttgagggcgaataaatgttttaagaaggggaggatgtaacgacccgacagatcgttttgagaattaacaccccgatcccctattaactgtttccgtcatgtctttttctgctattttgatttgctgggatggttcatattgagtttcgagtgttttgggacacttagtccctaaataagattttatgttttagaatttggaccgtagtcggaatagtgtaaagacgactccggaatggaattccgtcagctctgttgggtgatttcgggctgaggggcgtgtccggattgtgttttggaggtacttagcttatataggcttgaaatggcgaaagttgaatttgagtttcgggccgatagtggaattttttatattggggtcagaatccgattccggaagttagaataagtcagtagtggtgaatatgacttttgtgcaaaatttgggatcaattggacttggtttggttgatttcggcataggttgtagaattttgagattccaagttcattaattttagattagagggtgattcatggttttagcattgtttgatgtgatttgagggctcgactaagttcatatgatgttttaggatcagttggtatgtttggttgaggtcccgggggcctcgagtgagtttcagatgcttaatggattgaattggggcttaggcatttggctgaagatttgctacacctgttgtttttgtacctgcggattttagaccgcaggtgccgacaaccgcaggtgcagtgtcagagaagcggctgggacgccgcagaagtagaaagggtcctatgtagctatgaccgtaggtgcggctgggggaccgtagaagcgtgaccgcaaatgcgaccccagcctggataagtgacctttgcacttgcgataatttttccgtaggtgcgggaccgtagatgcggccccatgagcacagatgcggaaattgctaggcacaaaagaggattttaagagtttgaaatttcataacacaaaccttaatttggagctcggtgggaggcgatttcacgagtgatttgaaggaaagctattgggtaactaatcctaactgtaatttggtcataatacattaatcaattgttgtattccacatctaattaaggaatttgaaggtggaagtttggaaatggggaaaaagtttcccaattgaaaatgtgaggtttgaatgggaattagacatcagatttggatgatttttgtacgagtgaaatcgtgagtgaatgagtgttcataatttgtgacttttatccgattctgagacgtgggacaggggatgatttttgggtattttcctattttcttgtcttagttttgaatttattagctaaattagttgtttgtagctatatttacgttatgtaattgatttgattagatttggctcactcggagttagatactcgtggtaatagcatgatttcagattgattttgagcatagttcgaggtaagtggcttgcctaatcttgtgtgggggaactccccttaggatttggtactgttgttatatgaatgccgtgtacgtgaggtgacgagtgcgtacacgggctatttgtggaaaaaatccgttttcattaagtaaatatctatgtttcccttaaattgagcaaaactagtacatttagtcatcctgtttagctaggaaaacatgcttacgtgccttaactattttcactgctttaactgcctacttgggctttgtgaagcatgtttaaagtaagaattacctgtcttttttataggacataattagaactgtagattttccttgtttaaactgttgtgtatattgaatgagttgtgtatttagtttgggactacggaatggtattccgagagactcccctgtatgtttatgtttgggactacgggaaggtattttgagagacccccttgcactggatatttattttgggactacgaaacggtattccgggagatccttctgtgcatttacgatttggactacgagatggtttctcgggagatcttccatatatttacatttgggactacgagacggtataccaggagatcccctattgttatctctgtgtattgtattaatgttttttgtgatttcatttttcattgactgttagtatttatatttactatgatatttcatactattttaccttattatttatataaaccagtagggccctaacctgatctcgtcactactcgatcgaagttagggttggcacttactgggtactgctgtggtgtactcataccctttcctacacatgtctttcgtgtgcagatccaggtacctcttcctagccatattttcagtgaggcgaggtgatcttagagacttcgagatatatatgtcgtgtccgcagacctagatgtccctctctactctacctcaagttatagaattcctgtattttctttgttgatagattttctggagttagaaacactatgtacttctgtagcttgtgattcatgagtttccaggatttgggagtacttatgttcagttcgagagtgttttattgtatatgcggagaggcattttaaatctttttactagatttacctgttaaactgttagctttgatattttgctttattttcgtaaattgttaggcttaactagtcatagagactaggtactgtcacgacagttcacggagggagagcttgggtcgtgacattatataaccgttttatatacaccaggccattccgaaaagtgttgcataagcttctgcaagattatggttgttgcaactattagggaatgagaatgccatgataatgctgccattatctttcctcaatgcacctcccagtccagctttcccatcattcttgttaaaacttctatttatgtttagcttgaaagttccattctctggtttttgccattgcacaacaatgcaattttgtttggggtgcatccttactagagtatcgcaaaactgttcaaaggcaacttgagattacaattaggataagtcttattgattgcggtttccacattccaactgatttgctgcttcaacttatagaagttgaatatatttttatttacatgcctgcaagcacaaatttcttcccatagtacccaacaaataataataggagtaatacttaacactagtttatgtccatcattaatagacttagtttgccaccaggtatttaacatatatttaatagggtgagggtgatagttaattccaagttgagagccaaaaagttttcaaacataactagctggagtttgtctttccaaagtctccaaaccagaaatgacttattaaaaggagtataagaatgtcaaatcttaccaatgtgttgttgcttaggtctaggatttcttatgtcaagatatttgttggagtattttccattctctataaggtcccaataaaccgtatcctctttgtcttgatttccaatgtcaacttttaggatatgatttctggaaggacattcttcagctttctaacaccccacctgctctcagtgatgaattcacaaaccaaagtaacactaaacctacaagatgacctttcaaggttcaattatcccaccaaaaactacttgagcctgagttgacttgctagaccatgtacttttccgcaatgtttcttattttacgaacatgcttccaggcatgagaattcccattatttcgaaaccaaatgagatctaatgcaatttttatgtctaacatatgtttcccatagggataatgtgaacctgatcccctaccacattttcatagtcaacatgtcactgatatcttccgtctttctaataccaatgcctccctcatttgtaggcacagtgagattattccaggaactccaatggtaccttttatgctcaatagagctaccccagaaaaaattaacaaaatatttttcaattaatttaaaagtagttttggggagagggaggggaggggggggggaagggggacatagcatataaagtataaatgggcagagattgaaggacacttttaatcaacaatagatttaccaccatacgacaaaagcttactttgccaaccattgagccttttcactatcttactaatcaagatatcaaaatattcaattctttttctacccatatatagaggacaaccaaggtaattaaaaaaaaattattatccatgaaaccaacgcactcccttattctattaatcctgctagttgcagttttaggagttatgaaaaaacacttgtctctgttaaccagagcatttctcatagttaccaatttgcttcataacaagattaatagatgtgaaattaccactacagaaaatatcaatatcatctgcataggctaaatggttaattttagggaccttatcaggcatagaaaaaggggtaaatccaggatgattatacaaattattaagagatatggaaagaacctcagcaactataacgaacatagaaagggaaagggaatcaccttgttttagatcttgataggaagagaaaaaacctcgtctagatccattaataattatcgaaccccacatattcgaaatcaatttatgaactatgtctatccagtatttagagaattcaaatttacttaacacataataagcaaaaggccatgccattctatcataagccttaaccatatcaagcttaataacaatattaactccattattcttataagcaatcttgtgaataatttcttgagctagtaaaatattttcagaaattagtctatccttaacacagtcactttgattaggagaaactaatttatgcaaaagtgggtttaatcttaaagaagaattttagagatgattttgttagaaaatctagacagactaactggtctaaactcagaaaaacaagaaagagcattaattttgggaatcaaactaagcaagtatgagagaagaatttagtcaaacctttccttttcaaaaactccagaacaaatgcaatgacctcctctttgataatatcccatcaattatggaaaaacgttccattatatccatcaagtcgagttgtgccaaaagcactaaagctcaacacaacatttttgatttcagcttcatcaaacatcttactgagaattaagttatcctcctcagtaatgcaattagaaatatactctaaaatagcagggttgaggttaggtgttggtaagttgaactaggaattgaaggtcctgactgcagctttggagatctttttatcaccccataattcacttacccatatgatttttgattctatttacttgttgcttcctccttttttccctgagaatgcggtgaaagtatcttgtattaatatcaccagcttcaaaccatttgaccttagatttctgtttgagcagagagtcttggatacttagccatctaatatattcagcatgggctttgttcacattttctcaactctactcggtgttgttttcaatgtctttatctttcaaatattgaagcttctcctcccggttgataacagcctcattaatgtcaccaatgtcttccttagaccattggcttaatctcttactgagagcctcaaggttggattgcacgattcacataggattacccataacttttgtattccaaattttcttaacaatatcatagaaaccaggttgattaacccaacagttaaggaattcgaaatagttaatataattgtggttggcgtaaagatccttcataagcaaaggtctatgattaaatccagtcctagccaaattcctaacggaacatctttgaaacaattggtcgcatagatcattaataaaagctctacccatctttttcaaatattcttccggggcctcctattattacaccaagtaaaatttggaccggagtagccagtgtctgtgaccccacaattgtctatacaattttgaaattcaaggcttttgtacattctataaggtttaccgtctaattttttacttggttcaagaatcacattaaaatctccccagatacaccaaggtgcatccaccaattgactatcatgatccaaagataaccaaaggactcttctatcttctgaactgcatttagtataaactgcagtaacaaatatatcctaaatacctatagccttctccaatttgatggtaatgtgttgctcactttttgtaaaaattacttaagtgttgtatgaattccaaaagcaccaaatttgaccattaccatgagaatgacaatgttgataccctaggaatctcttgtatccgtctaacttttctttagtaataaaaggttcaacgacaactacaaattgtgtgttgttgatgtcaatcagctttttaagcatgtgaatggcttttttggacctcaccctccttatgttccagaagattgcactattcataagaacaatttggggtgagttcctctctttattttcttctttgagaaggatgtgttctgtttctttgacctttgccactttttagagtttcacttctccctcttttagcaatgtattggttttccactttttgactatcagaaacttcctctatgtctcattctctgtgtctctatttctttttgagctcatgttgattctgctactattgccctcattcatattgatcccaatctttgtcatccagatcaacaactaaatttaaaccaagttgattccttacttctgttggaacaacagaggagcttgaggcaccggttgtatgcttgtaaatttcctatgtcttgtcttcttcctcactactagtgtcacacctcctttttgcgcgccccgccccgaggggtaagatgcgcgggtggagtttttccaatttaagtgacaatattcgaaatgagattatttatttaattcagagtcgccacttgggaaaggtttggcttttggtgtcccaagtcactggtttatcttgaatcccaaatcgaggaaattttcgacttttccaaatgaagtctgcgaaccagaaattctaagtaaggaattctgttgacccgagggaaggtgttaggcaccctcgaatcccgtggttctagcacggtcgcttaaattgttataatggctaaatatctgatttaaatacatgttgtgacttatgtgcttttattaagttttaaccgcttttattattatcatttatttttatagaattgcaacgtcgtgaaaatgtatctcgaaccacgtcacaatcaatgcacccgtagttgttaacacatttcgactccgttgagatttgaaattgggtcacataaatgcgcacccgaatttaagaatgtgatttgattaagtcgcgcctaaagaatctaacgcgttattgtcttcggggagggcagtggaattcactaaatagcccgtcccaaattctaagtatttattatgaccaattattgagggccccgcaatttgccttttgatttggcgaggctcgtctcattattttagaagggtactctacaagaactacattttactacatttatcttttaatggaaggatgatgccgaattttgctggtttagacaaatacggactgaatccttattatgtttgccgaacctaaacttgtttgattacttgattgattgttcatgaggtgagagctacggcatgctttgtcttcaacaagtgaatatgcttattaattcgctaagtgagattgcaaacaaactaacaacatatattgagttatgttttaacgacctccaagttctattcttaacactctaacctattcgaaattgataaagaaatcggctgttttattaggaaaaattactactaattgaactcaaaaatgattatcagtttttctcaacaatcattacatcatttcgaaataaaaatctgtaacgaaacccagtatcgaacctgtattggaacgaataaactgacaagagaactggcattcatagccatactcttagtgtgactgtatgggagtttgtttggggatacatttatcccggacccagtatcgcagttttgtcaattcagtggtctaggcaaaatacatacaatgcttaccatgactctatgttatacagtcatactaaatcaaacaagtgttatacttgaactgaatgtatactaaatcaaaacatgctgtccatgtcatactgtcattactattgagccatgctatctaacaattcatcttaaacaaaatgtatgctagttcctacagaatatttgcagttcacagtaagaatacaggcccaaccaacattcgaactatctttttacaccaatgctataacataaactggcgttcattcctttatttctgcttcaacttcaaactttcaacaatacaaggttcaaaggttgtgtacctgggaatatttgcaattgaagaaaaagggcaatcagtagagtaacaatgaacaaatgcagcagcagtaacagcaccaacagcaacagggcagaatagcagcaggcataacaaatagcaagaaacaggctcgagtgcagagatgcaaatatggccaatagaaagtaatagccaaatagcagcaacacccagtggaatagaaacagaaatccaaacagaccagaccaatagtaaaccaatgaaaacactcgactaatagacacaactggaatttcaaagaatcagaattgatttgaaacaggtttaacaactgaaacccagtaataataggaggaaaaagcttctgattgttggttgtatcccctctctcccctcaactctctctgtctatgtgtatctatttgtatgtatttccagctctcctcaggttcaatccctcacagtattttttcttttacaaccctccaagtttttttttccgtcccttttctatatgtctatccctcctttttataagcctctatcctactctttttaaacagcctgttttcagaaatcacagtacctttcccatgtgctttccatttccaactttagctaattaaatattaaaccccatcaacattccctggcagatttcacttttaaaaggtttaaatacttctttaaactaaagccaagtatgggcagtggaatgtatctgacagcatatgctgtcaaattgtttaaaacttaacaaaggcctttatgcaggccacaggctgtgcacaaagcacatgaggtgcattaatgcacatgctgtgcacgaatgcacatgccttccaattcagaatctaaacacaaacaatccaacagctataagtgaactaaactggctcttaattgattcaggcaaatattcaatagaagcaaatcgatttaactttgctcagacagttgaaactaattgacgacacatgtcgactcgactatattagcattaacatacacaatcgaagccaaaaatcagacatttaaagtatgggacacatgacttgacttatactggttaaacaaaattatacttcgaggaatcagttaatcaatacaaatttggaacataaccaatgcacatgctttatcagaataggaggggttcaaacaaacaccgtggttcaagcaaagtggacaaacaaaagttggtaaaaattcaaagatacaaattgaaacaaaacatgaacattcattcaatcactcacatggaccaaacagaaataaagaaagcaagcaagactcacctcaaatcttgaaaaatcaaaaaaccttgactcggacttggacagactttcttaagggtgaatggactttaatcgaagtgtttctcagatgagaaacacttcgattaaggtccattagaccttaatctctttggtttggacggacataggcctgtgatgaagaactacaaagttccaaaactcagatccgggattcatactcccctggtcagattcggaccaaaccaagtatggtttggtcacgaggggggtctggggagtgtctggtatgaatttagggcagattggtgtagattaggttccgactcgaatcttcaaatgaagattcgagaaggtgggataggattcgaggtgtgtggttgatagatttgggttcaggacgtcaagggggttctacggtgttaggggcgaggtcaccggcgtccgtgccgccggcttccatggtgaaggatacaggggcggctctagggtttgattggggaatgaggttgacggaggctggggttaggatagggggggcagggtatgttacgggcttatatatggatggaaggggttgatctgagccattggatgaggcgagatggaaggctcagatctttcttttgatgaggaaacggcgtcgtctctcattcagagtttgggggtcggtttggataagacgggtcgggttagttcatgggtatggggatgtgatctaggccgttgatcaatctgagatcaacggcccagatcaacctgtattaaaacgacgtcgtttggattctctgggcatcaggtggtctggaccgggcaggcctgggttctgggctgttcgtttgggccaattttgttaaaattggcccaagtccggaagggaaggggtcttttctttattttttttattattattttttttatttatttcctttttcttatttattttaaaaacaaaactaagccaaaaaatcaaattaaaattaaatacacactcaatacaattatttgcacacacactaaaatatttcaaaacaggtaaagtcaaaccaaataaaatcaacggacgaaaatgcctattcatgattttctatttaacgaccggattacggtttgaattatgcaggacacatatattttttgaatttcattttaataaagtaaataaataaaaatgggccaaagtcacaaataaatcaacaaggtgccgcacagaaatccgaaattgtacagcagggccagttatattttttttttatttctttttggagcgattgtcgtgcgaaaacaaaaatcacgtgctcacaactagtatctttattatctgacatctaattgacaactcccatttctatgttaggagcttcctcttactctatcctttcattcctgaaagtatcattaacattgttgtgtcgctcttgttcttgtgtatcatgttctttctttctgaatattgtctctaatgatagttatagaataatcattttgttttctaatcgatgtagaaacaacattcgttttgctactgctctaggcaggtttgaatctcactttgcttttcttctttggcatccttttgattttcttctttcttatttcttcttcttcttcttcttcttcttcttcttcttcttcttcttcttcttcctcttcccttctttgttgctaatgctctttgtattttccttcccctcttccggttgtattttaatattgtcaacattgtgtgaatccacttgatttgtatcctccttgccatcattgttttctttcatcatcttgttcatagaatatgcttcatcgtcatttttggtaagctcgtctttatctcctttttcctttgcttgatcagcctttttcttttcaagagcactacaattaactatgtagtgacccagtttccaacaatgtacaatatttttggacgccttcatactcaaattttttgttatacctttttaacggcgattcatcattttcttgacacacaaaaatactttgaggcaaaggttttattaggtccacttccactctaattatgtgcatactgggccttattcaactaattataacaacatctagagcaagaggcatacctccagagctcaacatgtagtgctaatcatgcatatgaaacggtaaagctggaagaagcatccacgccgaagagactggcagatcctcttctggcttgatgtccggcgaccacttttgtaccacatctacataccgtcgatttcgataactcttctgaaccataccgatttccaatcgtccccattgaagagatcaatgaaaacattatgactgtcatagacccctattctgactgaccccttcagcagaataatttccttaaatcgtgacctaatctggtcaatttgggggcgtggtcctagaaattttcccacaattgtgtatttaaatgattcccccattatgccgtagtaatctttagctttgaaaattacagctggcatgccgttgtgtgtcatatgtcttgctatcactttttccttttcttggcgattggagtttggattggggatctgagcaactgatgaaggagttgtgatggtgttagcataggatggttttccaagattagaaccaacattgtgagctatttcacctattgggtgaatctgattcgctgtacgcgctggtgggatgcctctcggcggctccatctagtggagcgtgtgcagatgcattaagatatgaacttttagttagccgttgtagagaggaaaatgtttagagagagaatttttttgggcctacacacactgacgcgttgtaacataaagaaaaaaaagttacactgcaataatgtgtagctcgtaagatcaagttttagaatcatgtgtgtttctttttctcgtttatttaaatgcacgtttactccaaaaatttaacttagtcatttatactatctatgtaatttaacttgtcgtaatagatcgttgctttattttttagaaaattcgttctgcttctcatagatagtatgaaaacatttacttacacattgatcttacgagcaatatacgtaatacttttgctatagtttagcttgagaagcaaagacatttgacaggtttacataagttgaaaaatagtactacaatttaatgtaatactatctgaacaacgatttccgtttattacgtcaacaacctaacaaacacatgccatgacatcagttttggctttatgcttttctcttttatttattgaagaatttgagatattcttcttattttattctacgtgagctaaatattttactacatattaatatagcatcgtcctttcaaactagttgaggctttagttctttgtgtaacggttcaaatccagaattttaataccacaactacatactaaacgtgcgactaatagcctgaaatgaagccaaatatgtagagaacagctgatgaaatcactaaagtgtggttttcactcaatttgaattcattggatccaaacaatatttgagcaaaccatcaactaactcaagctaagacttgctcctgcttttctttatttctaataacttatatatatttttaatttgggatttactagccatctattatttggaccgttcaaaaagccatatatttcgaccagctaacacccaaatttaacgtttaccctcttcaaattttatatattatctttacttcaattatatgtccacagtccttaaacacggcttcatatgctggctggctggacatgagagactactaacaagagtgagattgcagaaaatagggataacccaagatacaaaatgtacaatatgcgacaatgaaccagagacgatagaacacttgttctttgaatgtcagttctcaaaagcgtgtttacaggaagtgctaaaatggttgaatattgcaatacaaaatatcatattacaaggcatatggagaaggctaacaagaggggtcaaaggagaaagttgcagattcgtgaaaaacagcattaacaacactggtatatgttatatggaaggcacgaaatgaaacattgtggcatcaaagagttccaaatcctgggacaatatgtactcaaattcagcaggaatgcaaaataagcattgatagaataggtagtaagaaaggaagtagaaggggcatagagtggatataagaagagctctgaacacaaactaaaatatgctcgctagtcgaatatagtaaaatataatatcgtatcgacagggattggagttaaacaatattattgtagtttgtagctggatcgctatgcaagatgatcaataatttagaattttatgtttaatactaaaattaactaagagtctaagatattgactaatgacaaataacgcaagtagtaagcaaaggaagatatcaatggggagaagatagggttgataagataggtgcaagataaatgtttgggatctaactctagataatccacttctaatgttcaagtgcgtcccgcaaattcacttggttattaattcaattgtttagtagaaactcctctctcgattaagtctcaacctcacaagataaaccaattttaagcatgagaagaaatgcaagaattcatagtagattgctctttaggagaacctctctcgattattctcctaattaggttcaatcaacaattcaactagcctctttcgattactaagaagaaataaagatttcaaacaacaaaatataaaacagcaatatcacaagttatgcctctctcgattacatgaactagtgaatataggagcaacgattataacatccaaaatgattcaatacattaaaaactagagttacttatccacaaacaagtattaatacaccaaattcatcaaaccctaaagaagaattactccatggatatggagaaattcatcacaattaagatcaagtcaaagcaaaacataaaacatccaaacccttgtcttgagtgaggatgaatggtgaaatccttgtgctcttgcttctccctcttctccttagcttctttaggtctaaattatgtcaaaagtcctcataataccattttttcatgtatatataccaagtagggtcgggcccgaacaattacaccttctcctacgtaaaaaaggatacttttcctgaacaggacgtgcgcggccgcaaaattttcacactgttctgccctatatgcacggtcaatgcgcggtttcacatctttccaacaatatattgtggagcctaaacaaaattctgagcaaaaggttatgtgtattttactagacagtgcataatatgcctactcgattttttgttcgttcttagctatcatccgtggatccccgaacatgatcccgacttaattccttgggcttttactcaagtttcaaagctctaaatcacttgaattcattccataacatctacatagatgggaatcacttctacaaggcataaaacatacaactagtgcaaaacactagcgattaagctcgtgactagtgacaaaattagtgcaaaacactcctacaaggcataaaacacacaattaggctcatgactagtgacaccgggttcaggcagtggttgatgttttgcatatttgtttccgcttattttgaaatacttaaacgaaagatttgtgataatatcttatttgtaatggaattaagaaaatgacctattatgtaattgtctattcggcttgcgtagtactgcgattggcgccatcacgatcggggcggtttagggtcgtgacaagttggtataagaacctaggttacataggtctcaccagtcatgagccagtttagtagagtcttgcggatttgtacgaagacatttgtaattatcttcgagaagctgcagaacctttacgaaaaacttctcattcttgaattcctgtcgtgcgaatctgttgattctggtaactaaacattttatattctattctctcacagacggtaagaacacgtggtaccggttagtacggacgactaccagtactaccagttggggccactagaggccgaggtcgtggtcgaggctgtaataggggcaggggtgtagcccacacaggagctaaggatgaacctgcagacccaccaaccaccctagttcacgatctggtcaaagttgcggatgctccaaaaggaccagctcaagcaccgattgtgccgattgttattccagaccttcaggaggccctagcccagattatatctgtgtgcactggcctagcttaggccatctcagttactacggccgcagctacttctcatgccaggagaggcacccagactcccgcagcttgcacatctgagcaggttgtgcacggaattcagacattgggggaacctccagcccagccaattgcacatgcttaggattatgtggtaccagttatgtctgacgacaaacagcattgattggagaggtttggtagactttagcctccaactttcagtggtgtagagggcgaggatgcctagggtttctcggacaagtgtcagagaatgctttggaccgaaggtattttggagaccagtgtggtctcgttcactactttccagttttcaggagctgcctttacttggtgggaggcttatgagaggcataggcctgttgatgcagcaccccttacttggaagtagttctctgctctctatttggagaagtatgtgccaaagtctcgtagagaggagctgcataggcagttcgagcatttgcatcaagatgatatgactatgacgcagtatgagattagattttcagagctagctcgtcatgctatttagttgattcctacggatagggagaggatcagtaggttcgtggatggcctcacatatcagctttgaattcttatgaccatagagagggtgttaggagctacttttgagcaggttgttgatattgcccgagatattgagtcagttcgtcgctatgagcgagatgagagggaggccaagaggtttcggggatctggtagttttggtgatgctccttcgagaggtcagtttcagcaccacaaaggttgtccatttagacatgttcagtcagctcgcccagttcatcatggggcatcatgtggccatggttctcacaattctcatcagggacattaatcacttagtgcccttccagcccagagtttgtcccgtgctccatcagtatagggctcttctataccaggctcttctactggtcatcctagtgctaggggttcccttcaatccccatcccccacactaggaagttattatcagtgtggagagtttgcacatatgaggagacagtgtcctcgtcttcttgggggtccatcttagtagaggagtcagccctcgacttcagctccagttactttaccacccacccaggcagctaggggtaggggtcagtcagctaagggtcgccctagagggggaggtcaatcaggtgggggtcaggcccgtttctatacactcccagccagactagatgttattgcttcacatgttgtgattacatgtattgtctcagtttgccacagagatgcctctgtgctatttgatcttggttccactttttcatatgtgtcatcatcttttgatcgttatttggatacgccctgtgagtctcatttttcattggttcgtgtatctactacggggggcgatactattgttgtaaaatgcatatatcgatcatgtgtggtgactattgggggtttagagaccccagtggaccttttgtttctttgtatggtggattttaatgtgatattgggcatggattggttatctccgtgtcgtgctattttggactatcatgctaagacagtgacgttggccatgccgggtgtgcctcggattgagagatgaggttcgactgattttgttcccagtagggtgatttcatttctaaaatcccaacgcatggttgggaaggattgcttttcttacttagcctttgtgagggatgttggtgtagagactcctactagtgatttagtcccgatggtgagggactttccagatttgtttcttgcagacctgccgagcatgccaccagatagggatattgacttcggtattgatttggtgccgggcactcagcccatttccattccaccgtatcgtatggcatcgacggagttgaaagagttgaaggagcagcttcaggaactccttaataaggggtttattcggcctagtgtgtcgccttggggtgtgactattctatttgtgaaaaagaaggatggcacgacgaggatgtgcattgattacaggcagttcaacaaagttacaatcaagaacaagtatcctttgcatcgtattgatgatttatttgaccagcttcaaggagcgagagtgttctccaagattgatctccgtttagggtatcaccatttgaagatcagggactcagacattcttaagacaaccttcaggacccgatacggtcattatgagttccttgtgatatcatttgggctaaccaatgccccaataacgttcatgcatctgatgaacaacgtgtttcagccttattttgactcatttgtgattgtttttattgatgatattttggtgtactcgcgtagtcagaaggagcacgctgagcatttgagagttgtattatagcggttgagggagaagacgctttacgcaaagtttgccaagtgtgagttttggctaagttcaatggctttcttgggacacgtagtgtccagtgagggtattcaggttgatccgaagaagatagaggtggtttagagttgaaccaaactgtcctgagccacagagattcacggctttcttggtttggtgggttattatcattggtttgtttaggaattttcatctattgcatcacccttgaccaaattgactcaaaatggtgctctattcaggtggttggatgagtgtgaggcgagcttccagaagctcaagactgcattgaccacaactctggtgttagttttgccatcagcttaaggttcatatacggtatattgcgatgcttctcgagttggtattggatgtgtgttgatgcaggagggtagagtgattgcttatgtttctcgtcagttgaagccccatgagaagaactaccctgttcatgatttggagttggctgccattgttcacacaatgaatatttggaggtattatctctatggtgtgtcttgtgaggtgtttactgatcatcgtaacctccagcacttattcaggcaaaaggatctcaatttgaggttgcggagatagttggagctgctaaaggattatgatatcactatcttgtaccattcgagaaaggccaatgtagtggccgaggccttgagtaagaaggcggtgagtatgggcagtttggcatatatttctgtcggggagagacctctcgcagttaatgttcaggccttagccaatcagtttgtgaggttggatatgtcagagcacagtcaggtcttagcttgtgtggtttctcgatcttccctgttttgatcgcattaaagagcgccagaatgatgatcctcatttattattcctcaagtatagagttcagcacgacgatgatagatatgtgactattggtgatgatgggggtattaaggatgcagggccggatatgtgtgcccaatgtagatgggatttgggagttgattttggagaaggctcatagctcgcggtattctatccatctaggtgccgcaaagatgtatcaggatttgagacaacactactggtggagaagaataaacaaagatatagtgggatttgtagctcggtgctcaatttttagcaggtgaaatatgagcatcagagaccgggtggcttacttcagcagatggatattccagagtagaagtgggagcggatcaccatggattttgtagttggactcccacggactttgagaaagttcggtgctatttgggtgattatggatcgactgacgaagttcgcgcacttcattcctgtgtgtactacatattcttcagatcggttagctgagatctatattcgagaggttgtttgcctgaatggtgtcccggtttccatcatttcagatagtggtactcagttcacattgcagttttggagggtagtgcagcgagagttgggtactcaggttgagatgagcacatattttcatcgtcagacggacgggtagtccaagagcactataagcgcttgtgtcattgattttggagggtcatggtatcagtttctaccgttcgcgaagtttgcatataataatagttattattcgagtattcagatggctccatatgaagctttgtatgggagacgattgttacacaccgtaagtttaacaaccttaccattatatgcatatatatgatatggtattttgagtgatacatttatgtaaaaaaatagtttgaaaaatataattttatatagttattaatattactactttcggatatgttttaaattatacacataatatgagaaaagtttatgagatgttcttcattgtaaagataagaattatttttttcacaagaaaagaaggttatcttttttttaccattttaaaaattaagtatacaaaaatttatactctttatatgaaattataaaacttataagttaagaaaatatatgtatttttacatggatattttaataaaataatattgtatgcatttattttatatggtaccacatgaccacgatagtaagttatataatatgtgttaaaagtgagtggtattttaagtaagttgaaataatttttaattatgcgactaattggtaactatccaaaaataaatttggataagaacatcatgtggtagccatgcaatagtcataagataaactcacatcgaacaaaataatataatgcttgaaagaaattgagtttccacactgccaaagatttcattttgcgcaagctgctttccaccttgaagtattctaatgccaatagaaccattgccccatcatccgccacgatatgctaatgaaactcttcatggtatagaatgtcattgttttcttcccttcattgccttggttccgaacgacgaccattgtagcttatccaaattcaaaattcccttcctttggtgtccagccccacaaatgaattgattatgagttccccgcctgcattgaaggctaagtcttgtgagcacgtgattgttgctctatgagaactactctctaaaattcaaaataaaatgattttgtgttgtttgcgatttatttgtattttgtctgcgcatgtttgtttctactttaaatgacaaaagtacaaaaatatgtgttgcatgtgcatttagggtttaattatgcatttctgaattaattaaaccacgtcctattttaaagaatgaaaatcgcgaaaaatatgaattccggtagtttgtcattttattgtttaattgtgcgattttattttttcgatcttgtgtgttaattgttattaagggttaattaatatctttttaaataatattggtttttcaattcaatttaggaattttgaattaagagaatagaagaaaaagaaaatagaagaaaaagaggaaaacaagagaaaattagactgggccaattgtaaaagagagtccaggcccagtccaaacaccttcttgtccagtccaacccagccagcctagggaacgaatggaacgacgccgtttgggcatggaaaatcagggccgttgatcttagctgatcaacggtccagatcaattcctctgtcacccgacccgttcccatcgaaggccgatccggtctcaagagtagacgaagcgatgccgttcctcttaaatgaagcaatccaggtcgttgatctcatcagatcgaacggcttggatccaatccccacgtacgtatataagacctccaaacgaaccccgcccccaaaccaagccccccctctcattcttttccaaacctcgtctctttcagagacgaggaaccctagtagccgccaccctatcccttcaccgtaaacccggcggcgctggctccgatggccataaaattaacacccctgagccttctaaccaccctcaacctgaatccctactccgttgtcctcgaatcatatcccagcttctcgaatcttcgatcaaagaccccgtcccaaaccctagcttgtccacataaccccaaaatcacacctaataatcccctagacctcctcgttgctaatccctaaccagattggttcaaatccgagtaaaaactcatcgaatggcggatctagggctcgacagttcgagattgtttcgaagctgtcaaggtcgaatggtttttggttagtattataagtctatttctgatgaaatagatgtataatactaactggaaatcaagttcgaaagggcatatggttgaaattcgagaaaagaacagtgagttcctctttacttctttttctttttttctatgtgtttgtttgtctgtgtgattagtcatttctttagggtttttagtttaagttaatccagtatatatattctgtttctttttctgattttggttaaattaaatattccaatgttgtttgagcagttcaatcaacttttggtttacctagattaggttcattgtaattcgtctattgtctgttattttctctcttctccatcagtttatgttctgtcgattaataacataggttataaatagtttcgtcgattagttcgttcttgtttgtaaaccaataagctcgtcaaatggttgttgcgtatgcttgatctatggacgcttagcttcagggcattgtcaataggctgacaatgaacctgcattcatgtgcatattgattcaattttcaatttcggtttaaatgattctgttgagttctgtgtgatgatttaaattcagttcattttgtttcaattgggattcgaccttagtcaattagctgtcaataagtttggttatagctgttagtcagatttagtttttaaatctttgttagcttgaacagatttcagaattaaaagttttgatatagttgaaaatttgtattaggggcagtaatattaaggggtttcaggggtgatttgggattggaacagttaggataatattttaatgttagtgttttgttagtgggatattagtgtctttaaattaatatggtaatggggaacaaaagggaatgaggggctgaaaataaggaaaagttttccttagtgggttttaaagtggaaaaattcagatttttagtgaaaaaggggggtaaggcagtaagtataagaaggcagagggaggtctgtagaagtggactgaaaattgaattctgaaagctgaaaaagttgaaaaagaatagctattttatttatctgatttaggatctgaaattagctagaactttcttccttttacttctgctctatacttggggaagtatatagttgctggttatttgtggctgcactactggttgtcatttctgttggttactactgctgctgctgaccctcttcttcctcttcttgtattgtctataccaggtacatgtcttgaatctcaaatcatgtagatgtccggttggaatgaaatgaaaatggaagtataacgtcattggaagctttagttcttgccgtgttttatcatagttgattgtagtagtttggactgtaattaaaattgttttacaatggtttagattggtttggactgttaaactcatggactgttcgggacatttgatcgtttgtaagacatgtggtagtttaatttcatttagtgtagttaagttttgaaaatcagaagttattcaaaatataaagcgatcttctgattcacagtcctcactcgtcctaataaatggctgtgtaatcctggagtcacattgttttgtattttgtaatggtaattgtgagttagtttagagctggacgtgtaatttgactgttggatttgcttatcactaattaccctagaatagtttgttgattaactctgttaaaagacatatgtttgaaaattgattctggacttgcatttttagctgataattggatatttaaatgattgtggataattagttaaggttaattgcaacatgagttaggaagtattattaactaggagctgaagcaaaactgtgctgaacgttattagcataaaattagtgtagaatttcaaactcagcatgttaagtgcatcacgtgtgtgttaacacaaaattagaccctgaattataacacggatacgttaatgctgctgttgatctcgcctgatttttgctaatgggccaagctgagcacaggtgtggctcacgctctgcaatgggaactcagactgagaagcatgttctcaaggcccaactcgctggttggtttcaattcagcagggattgggccaattacttgagcccataattgctaaagggtccttattaatatgttttgtttaagtaactccaattatttagggcctctttttatttattcttaggaacaaaatatagaaaatcatagttgctttaggtttgtcctgtaattaataaaatgagacgagcctcgaaaaactcaccgattgtggggccctcacaattgtatatatattaattacttagaactcgggatcgaccgcttagcgaatttcacggcctttttcccaaagtaataactcgttagtcactgttaggcacgtacttttaataatttaccttcttaactcgggtgcacatttatgtgacccaaatccaaatctcaacgaagtcgaaatgtgtcgttaatcacgggtacattgattgtgacgtggtttgagatgcatttccataacgttgcaaattcttttaaaaaaataatgaatgaaacgagcctcgacaaacaagaatacacaaagtgtgggcccctcaacggacagttatttcaaatgcttagatttcgagacaggccgcatagcgaactttacgactttttctcaaaaataacaaacgcgttagtatctttaggcgcgaatttaataatgttatcttcctaaactcgggtgcacatttatgtgacccaaattaaaatctcaacgaggtcggaacatatcgaaaattgcgggtacatttatgtggcgcaattagagatgcattctcacgacgttgcaattctttgaataaataataacaaaagcggtaaatagttaaaattttcacgtaggttcataattgtataaaatcaaataatcaagccgaatatgacagttgagctactgtgctagaaccacggaactcgggaaagcctaacaccttctcccgagttaacagaattccttatccggatttctcgtgcgcagactgttaaatagagtcattcttttcctcgattcgggattcaactggtgacttgagacaccacaaatctcccaagtggcgactctgaatctttaaataaaatcccgtttcgattgtcctttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaattgtcactgaagccggaattgatgatgatgaatggatcaaagctcgcttggaacagttgagcctgatagatgagaaaagattggcagcagtgtgccatggtcagctgtaccagaagagaatgacagagcgtataataaaaaggtgcgccccaggaagttttgaagtagggcagcaggtattgaagaagatcctcccacatcaggtcgaggcgaaaggaaaattcgtcccaaattggcaagggccttatatcgtgaccagaatattgtccaacggtgctttgtgtttgacagatgtcgaggggtagatgtgtcgacatggctatcaattcagatgcagtcaagagatattatgcgtaatttcattaattatggcaattattcggtttgtttgtttgtatttggcatttattggataatgagatgacggaggcaattctttcttctacccaaacactgtttaacccttgcttccccctttgagccttaagcaaattctttcaatgcccctcttttggaatcactaatgggaaagatacgaaaaaaaaagaaaaaaaaagaaaagaaaaagaaaagaaaagaaaagaaaaagacatgaaaaaaaggaaaagaaaatgaaaagaaagaaaagaaaaatcaaggaatataaaaccgtgggaactacgtttgacctgattcctcaaagaggatacgtaggcgcctcacggctcggtcatagtgtgcatcatagcaaatataggatgcataatgtacatagtgtgcataataggcacaatgtgcgtaacgcacgtagctcaacgtaagcataaaagataaattccccaagcaagaaaactggggcagaggttatgttttaagttccaacaaaggtttgattccaaaagtagtagcacatcacccttcaaatttgttttcatttttatagcctttcttcaaacccacaccaaaaccaacatcaacatccaaaagacctcccgatcaatgttcgagagatgccaaatccggcaaataagaccgagaatgatacactgatccccagcaaagaagaggatcgtgagactgggaatgaattgatagtcaaaggaatctccagaagagagggtcgtatctacaacgccctgattcatcgaaagaaaaaaaatgagagagtctcatcggtgaaaaccttcgcaggcaccgagaggcgacgtaagacgagggatatgaaatgagagagtcttattggtgaaaaccttcacaagcaccataaggcgccgggagatgagagaaaagagagagtctcattagtgaaaacccctcgaagggcactatgaggcgacaagatagagcagcaaaagctaccacattcgcaacaagatgaacatccatttatcatccccagcaagtcagaccatcggacaaatcgattgatacaaacagactgggtcgggaatctatggtgcacgccatgatcacggggaccagtcatgtcctccagataagttcttttgattagctcctcccacaaaatattggttcacaaagtttttctcttttccatatctttattttcttttcctaaaatgtgtctttaaagactttttcaaagcttactaccagaaatcgaaggggaattcatccaatgcaggagaatacaaacagtcttaaaagtcggcccctggcaatgcagggattgtgctcggaaattttgaaagaagtaagctccaaaagggagtggtttcgggaggtagaagcagactcccacagaatatgcttaaagagaaagcagaaaaggggataaactgaaaaccgatccccagcaggctagaaaccccccaacaggcaactttgcccgccaaccaattatggggacaaagagcaagagaaggggaagagagaaaaatggcgcgccagaaaggcaccctctaccaccacgattaaaactgattaaatccttttgtctgctgcagggaaaacaaaggattgatgatggcagcaagatgcaccgccatggaagtcaccaaaaaccggggcagaaaattttctgccaattgtcgaaaattttctcggaagaacggggaaaattactttaagttctaggtcgcccaccagtataatgcgggaatacattttaagttctaggcgcccaccagtataatgcgggaatacattttaagttctaggtcgcccaccagtataatgcgggaatacatttaagttctaggtcgcccaccagtataatgcgggaatacattttaagttctaggtcgcccaccagtataatgcgggaatacatttaagttctaggtcgcccaccagtataatgcgggaatacttttaagttctaggtgcccaccagtataatgcgggaatacttttaagttctaggtcgcccaccagtataatgcgggaatacattttaagttctaggtcgcccaccagtataatgcgggaatacattttaagttctaggtcgcccaccagtataatgcgggaatacatttaagttctaggtcgcccaccagtataatgcgggaatacattaagttctaggtcgcccaccagtataatgcgggaatacattttaagttctaggtcgcccaccagtataatgcgggaatacatttaagttctaggtcgcccaccagtataatgcgggaatacattttaagttctaggtcgcccaccagtataatgcgggaatacattttaagttctaggtcgcccaccagtataatgcgggaatacatttaagttctaggtcgcccaccagtataatgcgggaatacattttaagttctaggtcgcccaccagtataatgcgggaatacatttaagttctaggtcgcccaccagtataatgcgggaatacattttaagttctaggtcgcccaccagtataatgcgggaatacatttaagttctaggtcgcccaccagtataatgcgggaatacatttaagttctaggtcgcccaccagtacaatgcgggaatacttttagctctggagtttggaatcagtagccccacctgaagacggaaggttacaacagagagccccaagcaggaaaaacaataaaatccccagcaccaagaagcaggcaactgcagaggcaagcgcgcaattcaaaaggaaaaatgaacgcgtctcaaaaaatgtagtttgggaacgttgtagcatgcccagtataacaattctgatggaaagccataccactgaagaaaccattggaagatttaaagaagaaagccgtgtccccagcaaatcaagcaaagtgatgagaactgacattcagaaaaggtgaaggaccaacatcatctccaagttcacaaaatagaggcatcggaggaaagcgatagccgataagaaagcaaggcaacaagaacaagtcgaagatggatgagatttcaggatcctcagtttagcttagcttcttgttttccttctagagcaatgtaacagagagatcggttgagcagtagcatcctatagcagcatacaacagcgcacaacaacagcaagcaatacagtcacacggtagtcccagctaccaaaatttcccgaactacattgacctgattcctgttcagcccaggatatgtaggaaacctctgaagcaaaggttcggtcaaatctttttcaaaaaatgcttcacacggagtattcggacgggcaaaaatcgctcgctttatctttgcgcgaaaacccttcgtgtcttcgtgcaaagaggggcagctgtaagcacgtgatttttgcttcacggacaatcgctccaaaagaaaataaaaatagtggcaaaaggcttcgctgtacaatttttcgatctttccgtgacatgtgttgttagtcgtttctgagtctgtccattttgcatctagtcattatcaaacaaaaatacaaaaaaatatatgtggcgttaaaagaaaattcaaaaaaatatatataaatatatgtgcatcgtccgttttaggttgtgatttaacttacttggtatgataattatgttgaaatgccatattgttatttgttttaatttcatttgttttattagttatttttatttttatttttctttaaattggaaaacaaaagaaagctgaaatcaatttgggcccaaaagaataagacaaaaaaaaaggggcccaaaccaacgatctgacccggtccaaaccgactgcccaagcacctcctgaaacgacgtcgtttcaggcaaatcaatcccagtcgttccaatcaatccaaaggtccaggatcattttcggcaacccgtgttcaaacccgacccaataaccaatccgacccaacccctcacttaaaccaaacgacctcgtttaactaccaaacgaccccgtctcatttctcagcatcagatccaagccgttgagatcatttgatctaacggctcagatccaatcccctactccgtatataaaccttcccttacacccacgccccctataccaacaccccaccccttcgtccccaagctcaaacccagacctctcattagaaaccctggccgcccccgtctccctcgccattaaagccggcggcatggacgccggtggccacctcctgaacaccctaggaccacctcactgtcctgaacacaaatccactaaccacgagcctcgaatcacttccgttcgtctcgaatcttcatttgaagatttgagtcgaacccggatctatgccaaaccatcccatcttcataccagacactcccctgaccttcctcgtgaccaaaccaaacttgttttggtccgaatctacccacaactccctaaaaatcagatctggaaatccagactttagaacacatgcacctggggaatccgggcggtttggacatgggtttgaggtctaatagaccttaatcaaggcgttctcatgtgagaacaccctgattaaagtttgttcggcctcaaaagttcgaggttaaatcagatttgggtctgtttgatttaaacattttcggtaagttttcctttcttttgttttatttctaaataagttgtcagcatatctctttgtgtttggttgttattttgttatttttttggatttctttcatctctgtaaagaccttttatttggtcaattgttttctgtgtatgatttgaatgtattctgtgatgaacatgttcgattagattagtcgtcaaatgaataaacttatataggttcccagtaattgaacacaaaattgtctgatgccctttaggtccctgaacatattgtttatgtgagcgactgattattacttgctataattagtatagtcgactcgataaatgtcgttgattagtttctataactaatgaatcaaacgagctaataatgtcgcatgactaattgatactttgccactgattgaaggccccaacattgtttgaaatagtttgtttgcattgaaaaatgactgaaaggttcagtctaggcagtcctgaatttgaactttcatcagttcaaaaatgccctgatgctgcaaagggtcaagacagtgataaccagggtttaacaggggtagtctggggtttgaaaaggacaaaaatgattagtttaaatgagctgacaagtagggtactaatttaggattaaactaatacccatggggagcaagacataagagtatgaggcttaaaatgaataaataaaacgagcccataactcttgattaaacaaagaccaggcgtggggaacaaatgggctggtaccaaagatgcttaggcatgggcttatagggtatgggcattctgccaattggcagggcaggcagctcagctgtactggttcatttggcctataaataggccatttgataacttaaatagggtagagattttagtctggagaaaagagaaaaacaaagtgaaaattttcagaatactttgactaaaacattgcccaaaactgcacaaggaactaggttggttgagctgttctggccaagtcagttattctaactagggtcatcactgttccgttaagagaaggctgtgtgttttctgctgtgattgttactatactgagttttctgtgagctgtggattgagttttagccttcttgattgttggaactgtactgagtacttgctgagttttgtgattattggatcttctgttgctgttacatttggtatcttgggttttcggttggttcattgttctttttctgggatttgtctgtctgatgctcaagcacctgtgggctacatagttgctgttggttgtgttgctgcgttgttgctatctgttgttgctgttgattacttgctgctgatactctctctcttcctcttcttattgtgcaaatatccaggtacacgactaatactgtcaatgtaacttgaagttgagtatgaatgcaaaagagaagaattgaagattatttactttaagcataggctgttgtattgaatatcatgtaatgcatgatagtttacattcgtttggatactgaaggcaacttgcatgcatagtaaatatcaatgtatggggattgaatgttagttatatatgtaggctgttagatgaatattcctaatgcagtaggttgtatcccagacttaggtttaaattgtgtaacatactctttaatgtaggccaggcatgtaaactatccactgctagtatagttctttccccttttgctagtttgtcacatataaattgataaagaacaaagaatcagttctaggcctccaccccaggaaggccgagcccaaatcgaaagtcagctaggcctgtatcggaaaaacagggcccaagtcgggccatctcgcatgagctggatttgggcccataatttgcgactagtgggccataaatgcagtcacattttattattctgtagcagcactttaaatacggttttataatcaactaaggctatttactgctttcaattgatagagacaaacacgacgagaaacatagttgctataggatatcccttaaaaataacaacgagatgagcctcgataaaaataaacaaaacgcagatacggggcccttgttaaatgcatattagtgaagcatttagtttccaggacgggttgtttagccaatctcacaacctccctaaaaataacaatacgttagactcttaggacgcgccttaataaatcttaccttcgtaaactcgggtgcacattgatgtgacccaaatccaaatctcaacggaatcgaaaaatgtgtttctaatcacgggtacattgactgtgacgtggttcgagatgcgtgtccatgacgttgcaaattcattttaaaataaggatgagataagcctcgccgaataaaaatataaattgcggggccctcagtaaatatttgtttaaaattacttagacttcaggagggccgtttagcgaatttcgcggccttcccaaaataataacacgatagtctctttaggcgcgtcttaataatttattttttcttaattcgggtgcacatttatgtaacccaaatccaaatctcaaccgagtcgagatatgtcaataaccacgggtacattgatgtaacggggttcgagacatgttttcacgacgttgcaagtcctataaaataacagtgaatgataaaagcggtaaaaagttaaaattttgcacgtaagttcactcttgtataaaatcagataatcaagccaaatataacagttgagcgaccgtgctagaaccacggaactcgggaacacctaacaccttctcccgggttaacagaattccttatccggatttctggtacgcagactgtaatatagagtcattcttttcctcgatgcgggattaaaattggtgacttgggacaccctaaatctcccaagtggcgactctaaaataattaaacgaatcccgtttcgattgtcctttaattggaaaaactcccttgcaccctctctggtgcggaaaaaggaggtgtgacaaagggtacagaggccgagaacattcactccactgggagaaacctatgctactttgttccataagttgaggcagttaggcctattaagtcttgttgagcccaaattgccaaatccccttcccaaaaatctggaccactcagtaagctgtgaatattgttcgggggctctcgggcatgatactgagaagtgttggaagttgaagactgccgtacaagatcttatcgacacaaataggatcgaggttcaggcactagaggcacccaacatcaatgagaacccgttaccggtgcaccaagaggcccacatgatcgaacttgtgcacgaaggagggaagcccaagaaaccctcacaaacgataatgatgattcgtgccagtccaagcgagaagccgaccagtggaaaggcagtggtacagttgggaagggtagatgacaagccagttgtggtaatagggaaaggttcgtctgtcgttgcgaagaagccggagccggcaaggtagtgctgcagggagtatcaagcacaccagtgttagttgtgaaaggggcccgcgtagaaccagttgttatcaggccagtaatgcagttgccgataacaagtgagaaagctgtgccctagagctacagtcaagtgacagtgatgcataaggggaaggaggttgtggaagaagtatgcgaggcccaggggttaactcgttcgggaatgtgttttgttcccctagaattgagaagggccaatcctataacaaaaaaaaagccagtgacggaggaagaagcagaggagtttttgaagaagatgaaggcaccagactatccattgtagaggagttaaggaagaccctgacccagatttcgttgctatccttgttgatccattcaagcgatcattgtcgggtattaatgaagattctgaacgaagcccatgttccggacaagctctcagtgaacatttggagaaaatagtgcacaaaatcttcgaggtaaaccgagtgacattttctgacgatgagttgccagtagagggtatagaaaacaacagagcactctacctgaatgtgaaatgcgaagactcgatggtcactcgagtactgattgataatgggtccagtgccaatatttgtcctttgtccactctgaacaaaatgaaggttgatgatgataggattcacaagaacaacgtctgcgtccgatgttttgatggggacggtactgacacagtgggtgatatcattctgcaattgataattggtccggtcgagttcaccatggaatttcaagtggtagacgtggcggtgtcatataatcttctgttgggacgaccctggatccacactgccaaagtagtgccctctacactgcattagatggtcaaatttgaatgggatagataagagattgtggtacacagggatgacggtacacacgccgttagtgatgccattgtgcccatcatagaaatcgacgatgacaagggcccatgggttcatcaggtttttgacgcagtctcagtggacaaaattcctgagggcgggggccttctacttcctagaatcgcagctgcgaccttcatgatagcctcggagatgttaaacaatgggtttgtaccaggaaaaggtttgaggattgatctgtagggaattgtccagccagtttctttgcccaagaatctggatacttttgggctgggattcaagcctacggcagcagatgtaaagcggggttgcaagttgaagaaaagagtctgggtcctccctaagccaatcccgcgcctatccagatcatttgtcggagcaggtattagagagttgtcagtcccgaaggttctcggaccactgatcgggccagatggagatttgaatgaagactttgaaaggctgttcgctgatgtcaacatgatagaagctggagaaggttccagtaaggcagacatacagtttgtggggcctagggacaatgtcaacaattggtcagctactcctcttcctactcggagggagtcctggtagttggctctgattttccttcctgttttctggattattccagggttgtaatccagattcctttttatttttattgtgttcatcaaagtgtgaaaccttgttatcccataattcaataaaataaaaagtttcttcttcattccttattttattttttattttttaattttgttttctacttttctttttctgaacagttctctttatattggttctattgacatggcatgcccaacggatcttcatctcagtctaaaaattcaatctaattccgaactaattgtacaagaggtcgattatgataatgaatcggaatctgatgaggatgaagccttcgaagagataaacagagagttaagccagtttgaagagaaatccaagcccaacttaaatgacacagaagccatcaatttaggggatgcagatgatatccgggaaactaaaattagcatccacattgcaccaaatatcagggaagaactaatcaaaacacttattgagttcaaagatgtttttgcatggtcgtatgatgacatgccggggttaagcatgaatttagtgcttcacaaattgcccactgacccggcatgccctcccgtcaagcaaaaattgaggaagttcaagacagatatgagtgtgaagattaaagaagaagtaaccagggtgtgcgtcgattaccgggtgtgcgtcgattaccaagttcacccgatatcctgattggttggctaatgtggtgccagtgccgaagaaagatgggaaaatcagggtgtgcgtcgattaccgcaatctgaatagggcatgcccaaaagataactttccattacccaacatccttatcttaatcgataattgtgccggacgtgagatcggatcttttgtagattgctatgctggatatcatcagatgcggaaaagacgacattcattacgccgtgggggacttattgctactgggtaatgccatttggtttgaagaatgctggggcaacgtacgtgagagcaatgactactgtgtttcatgatatgatacacaaagagattgaggtatacgtggacgatgtgatcataaagtccaagcatcaggaagtccacgtagcagacctaaggaagtttttccaaagacttcgaaggtatgatattaagctcaacctggccaatgtgcatttggtgttccatctggaaagctgttgggattcatcgtcagtaggcgaggcattgaactggacccgtcaaagatcaaatccatccaagatttgccatcgccgaagaacaagatagaagtaatgagtctgttgggaagattacatcagcaggtttattgctcgactcacagcaacttgtgaacccatttttcggctactgaagaaagatgctgcgatagaatggacggtagaatgtcaggaggcatttggccaaatcaaaggatatttatcaaatccaactgtgttggttcccctgagccggggagaccgttaattctttatctaacggtcctagagaattcgtttggctgcgtattaggacaacacgacattacaggaaggaagagcaagctatctattatctcagcaagaagtttacagtatatgagtttaagtacactcaacttgagaagacatgttgcgccctaacttgggtggcccagaaattgaagcattatctgtcatcatatactacttatctcatttcacgcttggatccattgaagtatattttccagaagcctatgcccatagggaggttagcgaaatggcaaatattactcacgaagttcgacatcatctatgtgacgaggacaaccatgaaagcccgagcactggccgatcacttggctgagaatcctgttgatgaagaatactagccattgaggacgtattttcttgatgaagaagtgatgcatatagatgagttggatttacctgaggaaccaggttggaagctcttctttgatggagccgcaaatgcaaaaggagttggaataggagcggtacttatctctaaaacgggacatcgttatcctgttacggcacaactgcgtttctattgtaccaataacatggctgaatatgaggcatgcattttgggtttaaggttagctgcggacatggatgtccaggacgtcttggtcttgggagactcggacctcatggtgcatcagattcagggtgaatgggaaataaggcatttgaagctcataccataccgacaatgcttgcttgatctgaccaagtgatttcgatcagtgcagttcagacacatcccaagagttcataatgaggttgccgatgctttggctactttagcatcgatgttgcatcacccagacaaaattcatattgacccgttgcctatccaggttcgtgatcagcaagcttattgcaacatgatagaggaagaaatggatggcgagccatggttttatgatgtcaaggaatacctcagaatggggatatacccaaagcgggccatagaagatcaaaagagagtcattcggcgattggcaaatggattcttcctcagtggaggagtgttgtacaagagaaccccagatttgggattgctgagatgtatagatgctagtcaagccacgacagttatgacagaggtacatgctggagtctatgggccacatatgagcggatatgtgttggcgaataagattcttcgagcagggtattagtggctcactacggagcgtgattgtatcaatttcgtgcgaaaatgccatcaatgtcagatacacggagatttgattcattctccgccgatagaattgcacacaatgtcaacaccatggccatttgttgcttggggcatggatgtcattggacctattgagctggcagctaccaaaggtcataggttcattcaggtgaccatcgactatttcactaagtgggttgaagctaaaactttcaagtcggtaacaaggaaagcattggtataatttgttcattcccatatcatctgtagatttgtggtcccgaaagtgatcatcacggacaatggtgctaatcttaacaacagtttgatgaatgaagtatgtcagcagttcaagattacacatagaaattccaccccatattatcccaaggcgaatgtagcagttgaagcagccaacaaaaacataaagaagatactttgaaaaatggtagaaagttcgaggcattggcatgaaaaattaccatttgcattgttgggttatcgcactactgtccgtacttcggtaggggcaactccttatttgttggtatatggaactgaagcagtaataccggtggaagttgaaattccatccctttggattgtcgctgaagctgagattgatgatgatgagtggatcaaaactcgtctggagcagttgaacttggttgataaaaagagattggcagctgtgtgtcatggccagttgtatcaaaagagaatggaaagagcatacaacaaaaaggtgcatcccctgaagtttgaagtgggccagcaagtgctgaaatgcatccttccacatcaggctgaggcaaagggcaagttctccccgaatgggcaagggccattcattgtaaccagagtgttgtctaatggcgctttgtgtttaacagatatcgaagggaaatgcgtcgacatggctatcaattctgatgcagttaagagatattatgtatgatttcttttaattgtaattgttgtttgcttgtacttggcatttatcggagaatgaaatgacggagacaattctttcttctatccaaacactttaacctttgcttcccctttttgagccttagttattctttcatactcctcttttggaatcagtaatgaaaatgaaatagaaagagaaaagaaaataatgataataaagacaaaagaaaagtcacaagaaaaacaaaggaaatgggaactacgtttgacctgattcctcaaagaaggatacgtaggcgtctcgcggctcggtcatagtgtaacgtagtgtgcataatgtaacataatgtaataaaaaataaaaatccccaagcaagaaaaactggggcagaagtttgtgtttgtaattttggaaagaaagtatgattccaagagttgtactattttacccatcacgaaaacccatattgatgtccaaaaaagacctcccgatcagtatccgagaagtgccaagtcatgcaaatggaagtcggggatagcaccccgattcccggcagagaagaggatcatggactggaactgaattgatagccgaaaagaatccccagcagagagagtcatatcggcaacactccaatccccagctgaaaaataaaataaaatgagagagtcttatcggtgaaaaccttcacaggcaccataaggcaatgggagttgagagaaatgagagagtcttattagtgaaaacccctcgaagggcactatcaagcgacacgacaagattggcggaaagggtccacatttggcaaagagttgagtgctttttatccccagcaagatgaggccgttcgaaagattgattgatgcaaatagactgggttgattagtccggaatgcacgacatgatcgttaggatcagttatatcattcagataagttcttttctttctttttccccagcatttgttcagaaagacttcttctttttctattttttgaaatcaacacttttcatttcttggtttaaatactttacctccctagcagtttgtttttgaaaaggattttcagagcttactaccggttgccaaagtggtgcaaagcaaaatgcgaataggacaggccaaagataaggcgacaaagcgaaaagaagttggtcgaaagaccaaatgatgattgggtctagatcccaagaggaccaaatttccaggggaagttggagaaaaacgaaaaagcaacagttaaaaggttatgaggatccccaacagatttgcaagatacaggaacaactatcatccccagcaagttttgtaataaaacgcaaagcagggaaagggagaagaaaaaaaccatccccggcaggagtggcacgaccactcaccacgttttaaactaacaattttttttgatttgaagcagggaaaggaaatattattgacaacaggaagacagggccacaaagaagattatctaactggggcagaaattttctctcattacgaaaattttcttgaaatcagatagccacttagggaagagggaagataacacgagttttgaaggaagtgaaatccccagcaatatgtgagagaaagcgatacatgttttaaagaaagcaatcttggaagaagcaagataacccaagttttaagggtagtggtctttgaatcagtatcatccccaccattgttaaagggaggaaagtaactagtcttaaataaggaagataattccccagcagtgttatccctggcaggtttcagagaagtaaaaacaccagcttgaggaaagtagtccaagtggaaggaaggcaccagctttaaagaaaatagtctgtgaagaaggaaaataacatagttgtgaataaaacactggcgttgtccccagcagttttcggaggaataagacaccggttttgagggaagcagttgaaagaagatgattcaagttgaggagtcaagagcctacctagagaatggaggtgttacatttaaggagttgttgaagtcaggagcccgcctggagaatggaggtgttacatttaagaagttgttgatgtcaggagcctgcctatagaatggaggttgttaaatgttaaattgttgaagtcaggagcccgcctgtagaatggaggttgttaaatgttaagttgttgaagtcaggagcccgcctggagaatggaggtgttacatttaagaagttgttgaagttaggagcccgcctggagaatggaggtgttacatttaagaagttgttgaagtcaggagcccgcctggagaatggaggtgttacatttaagaagttattgaagtcaggagcccgcctgtagaatggaggttgttaaatgttaagttgttgaagtcaggagcccgcctggagaatggaggtgttacatttaagaagttgttgaagtcaggagcccgcctggagaatggaggtgttgcatttaagaagttgttgaagtcaggagccttcctggagaatggaggtgttacatttaagaagttattgaagtcaggagcccgcctgtagaatggaggatgttaaatgttaagttgttgaagtcaggagcccgcctgtagaatggaggtgttacatttatgaagttgttgaagtcaggagcccgcctggagaatggaggtgttacatttaagaagttgttgaagtcaggagcccgcttggagaatggaggtgttacatttaagaagttgttgaagtcaggagcccgcctggagaatgcaggtgttacatttaagaagttgttgaagtcaagagcccgcctgtagaatggaggttgttaaatgttaagttgttgaagtcaggagctcgcctggagaatggaggtattacatttaagaagttgttgaagtcaggagccctcctggagaatggaagtgttacattttaataaagttgttgaagttaggagctcgcctggagaatggaggtgttatattttaagaaggttgttgaagtcaggagcccgcctggataatggaggtgttacattttaagaaagttgttaaagttaggagcccgcctggagaatggaggtgttacattttaagaaagttgttgaagtcaggagcccgcctggagaatggaggcgttatattttaagaagtaattggtgttgaagtcagtaaagaggaggaatacaaccaaaatccccagcgggaaacaacaaaaatccccagcagagaaaggcagttcaagatttgaagggaaaataatgcgaagctcgccagaaggaaataaacagttctagatcggcgatcaagggagaatacaagtcaaattagaagtaaagaaatacaagaggaaacacaaggcaacaaggcaacaacagtcacatgaccatgctcgggaataaatctttgtaattcatagatcatagcttagtataacttctttatctattatcaaggtgtaataaggaggtcagtaagcggtaacattagcaacaacagcagtaacaacaaaattgcagtcccatggtagccccaactattaaaatttcccgaactacattaacctgaatacctctagccagagatatgtaggaaacctttgaagcgaaggttcggttaagtactttcaaaaaaaaaaatgcttcacacggagtattccaacgtgcaaaaatcactcgtgtccgctcacttcatctttgcacgaaaaccctttgtgttttcggacaaaggggggcagctgtgagcatgtgatttttgctctatgagaactactccttaaaattcaaaataaaatggttttgtgttgtttgtgatttatttgtattatgtctgcccatgtttgtttctactttaaatgagaaaagtacaaaaatatgtgttgcatgtgaatttagggtttaattatgcattttggaattaattaaaccacgtcctattttaaagaatgaaaatcgcgaaaaatatgaatttcggtagtttgtcattttattgtttaattgtgcgattttattttttcgatcttgtgtgttaattgttattaagggttaattaatatctttttaaataatcttggtttttcaattcaatttaggaattttgaattaagaaaatagaaaaaaaagaaaatagaagaaaaagaggaaaacaagagaaaatcggactgggccaattgtaaaagagagtccaggcctagaccaaacaccctcttgtccggtccaacccagccagcctggggaacgaatggaacaacgccatttgggcatggaaaatcggggtcgttgatctcagctgatcaacggtccagatcaattcctccgtcacccgacccgttcccatccaaggccgatccggtctcaagggtagacgaagcgacgccgttcctcttaaatgaagcaatccaagtcgttgatctcatcagatcgaacagcttggatccaatccccacgtaagtatataagacctccaaacgaacctcgcccccaaaccaagccccccctctcattctctcccaaacctcgtctctttcaaagacgaggaaccctagtagccgccaccctatccctttaccgtaaacccagcggcgccagcttcgatggccataaaattaacacccctgagccttttaaccaccctcaacctgaatccccactccgttgtcctcgaatcatattccagcttctcgaatcttcgatcaaagaccctgtcccaaaccctatcttgtccacttaacccgaaaatcacacccaataatccccttgacctcctcattgctaatccctaactagattggttcaaatatgagtaaaaccattgccccatcatccgccacgatatgctaatgaaactcttcatggtatagaatgtcattgttttcttcccttcattgccttggttccgaacgacgaccactgtagcttatccaaattcaaaattcccttcctttggtgtccaaccccacaaatgaattgattatgagttccccgcctgcatggaaggctaagtcttatgagcacgtgatttttgccctatgagaactactccctaaaattcaaaataaaatggttttgtgttgtttgcgatttatttgtattttgtctgcgcatgtttgtttctattttaaatgagaaaaatacaaaaatatgtgttgcatgtgcattaagggtttaattatgcatttcggaattaattaaaccacgtcctattttaaagaatgaaaatcgcgaaaaatatgaatttcggtagtttgtcattttattgtttaattgtgcgattttatttttttgatcttgtgtgttaattgttattaagggctaattaatatctttttaaataatcttggtttttcaattcaatttaggaattttgaattaagaaaatagaagaaaaagaggaaaacaagagaaaatcggactgggccaattgtaaaagagagtccaggcccagtccaaaaaccctcttgtccggtccaacctagccagcctggggaacgaatggaacgatgccatttgggcatggtaaatcggggccgttgatctcaactaatcaacggtccagatcaattcctccgtcacccgacccgttcccatccaaggccgatccggtctcaagggtagacgaagcgacgtcgttcctcttaaatgaagcaatccaggtcgttgatctcatcagatcgaacggcttggatccaatccccacgtaagtatataagacctccaaacgaaccccgcccccaaaccaagccccccctctcagtctctcccaaacctcgtctctttcagagatgaggaaccctagtagctgccaccctatcccttcaccgtaaactcggcggcgccggcttcgatgaccataaaattaactcccctgagccttctaaccaccctcaacctatatccccactccgttgtcctcgaatcatgtcccagcttctcgaatcttagatcaaagaccccgtcccaaaccctagcttgtccacttaaccccaaaatcacacccaataatccccttgacctcctcattgctaatccctaaccagattggttcaaatccgagtaaaaactcaccgaatgacggatctagggctcgacagttcgagattgtttcgaagttgtcagggtcgaacggtttctggttagtattataagactatttctgatgaaatagatgtataatactaactggaaatcaagttcgaaagggcatatggttgaaatctgataaaagaacagtgagttcttcttaacttctttttctttttttttctatgtgtttgtttgtctgtgtgattagtcgtttctttagggtttttagtttaagttaaaccagtatatatattctgtttctttttctgattttggttaaattaaatattccaatgttgtttgagtagttcaatcaactcttggtttacctagattaggttcattgtaattcgtctattgtccgttattttctctcttctctatcagtttatgttctgtcgattaataacataggttataaatagtttatttgattagttcgttcttgtttgtaaactaataagctcgtcaaatggtttttgtgtatgcttgatctatggacgcttagcttcagggcattgtcaataggctgacaatgaacctgcattcatgttacctgcattcatgtgcatattgattcaattttcaatttcagtttaaattattctgttaagttctgtgtggtgatttaaattcagttcattttgtttcaattgggattcgaccttagtcatttagctgtcaataagtttggttatagctgttagtcagatttagtttttaaatctttgttagcttgaacaaattttagaattaaaagttttaatacagttgaataattatattaggggcagtaatattaaggggtttcaggggtgatttgggaatgaaacagtttggataatattttaatgttagtattttgttagtgggatattagtgtctttaaattaatatggtaatgggaaaaaaagggaatggggggctgaaaataaggaaaagttttccttagtgggttttaaagtggaaaaattctgatttttagtgaaaagggggggtaagggagtaagtataagaaggtagagggaggtctgtagaagtggactgaaaattgaattctgaaatttgaaaaagttgaaaaagaatagctattttatttatctggtttaggatttgaaattagctagaactttcttccttttacttctgctctatacttggggaagtatatagttgctggttatttgtggctgcactactggttgccatttccgttggttactactgctgcttctgaccctcttcttcctcttcttgtattgtctataccaggtacatgtcttaaatctcaaatcatgtagctgtccagttggaatgaaatgaaaatggaagtataacttcattggaagctttagttcttgccgtgttttatcatagttgattgtagtagtttggactgtaattaaaaatattttaaaatgatttagattggtttggactgttaaactcatggactgttcgggacatttgatagtttgttagacatgtggtagtttaatttcatttagtgtagttaagttttgaaaatcagaagttattcaaaacataaagcgatcttctgattcacaatcctcactcgtcctaataaatgacagtgtaatcctggagtcacattgttttgtattttgtaatggtaattgtgagttagtttagagctggacgtgtaatttgactgttggatttgcttattactaattagcctataatagtttgttgattaactctgttaaaagaaataagtttgaaaattgactttggacttgcatttttagctgataattggatatttgaatgattgtggataattagttaaggttaattgcaacatgagtcaggaagtattattatctaggagctgaagcaaaactgggatgaacgttattagcatataattagtgtagaatttcaaactcagcatgttaagtgcatcacgtgtgtgttaacacaaaattagaccctgaattataacacggatacgttaatgctgctgttgatctcgcctgatttttgctaatgggccaagctgagcacaaggtgtggctcacgttctgcaatgggaactcaaactgagcagcatgttctcaaggcccaactcgctggttggtttcaattcagcaaggattgggccaattacttgagcccataattgctaaagggtccttattaatatgttttgtttaagtaactccaattatttagggcctctttttcttcattcttaggaacaaaatatagaaaatcgtagttgctttaggtttgtcctataattaataaaatgagacgagcctcgcaaaactcaccgattgcgaggccctcatgattgtatatatattaattacttagaactcgggatcgaccacttagcaaatttcacggcctttttcccaaagtaataacgcgttagtcactgttaggcccgtacttttaataatttactttcttaactcgggtgcacatttatgtgacccaaatccaaatctcaacgaagtcgaaatgtgtcgttaatcatgggtacattgattgtgacgtggtttgagatgcatttccataacattgcaaattcctttaaaaaaataatgaatgagacgagcctcgacaaacaagaatacacaaagtgcggggccctcaacggacagttatttcaaatgcttatatttcgagacaggccgcatagcgaactttacggctttttctcaaaaataacaaacgcgttagtatttttaggcgcgtatttaataatgttatcttcctaaactcgggtgcacatttatgtgacccaaatccaaatctcaacgaggtcggaacgtatcaaaaattgcgggtacatttatgtggcacaattcgagatgcattcttacaacgttgcaattctttgaataaataataacaaaagcggtaaacagttaaaatttgcacgtaggttcataattgtataaaatcagataatcaagccgaatatgacagttgagcgactgtgctagaaccacagaactcgggaatgcctaacaccttctcccgggttaacagaattccttattcggatttctggtgtgcagactgttaaacagagtcattcttttcctcgattcgggattcaaccggtgacttgggacaccacaaatctcccaagtggtgactctgaatctttaaataaaatcccgtttcgattgtcctttaattggaaaaactctcttttatgcccctttgcggggtgtaggtaaaaaggaggtgtcacaagtctgccaaatgatcagctagcttgttacctcaggtttattctcttgtatcaaatgacttggttgtttttctgtaggcctgtcattgctcaaatttccgagacaaatcattctattagaagtagtatctgcaaaagtaaaatctttctaaataatattatacggatttttccctactttgatccgccgttacgtgttttcgcaaaagagaatcggctcaggaatgttaagtctatcccttctttcttttttgcattatctatacgatacaagagaaatgagcaaatgcacaattttcttaaattactctatttgtagaaatgctagagatgtgtatattctttttctcccataagtcttattattctatcatttgttcatgagtcttagaaaaactagagttatataaaaacatactactaaaccattgtgtatgtatctgcagcattgaagaatggtgtttaacaaatcttgggttccgaagaggaaagaatatcacttaaatccgaaaagagtaatatctaactaatactgtagatcacaggaagcttgttccacaataacttttggcttctagaagcattaccttctttgttcattcttcatataactcattgaaccgaaagtcacatttagcctcaatcgtgctaaaacgtaaaaatagcacggtaaagccagctttcggattgattattcaaaaatagccagtgtttacgaagtcaatgaaaaatagccactattttgctgcaataaagatcggtccagcataatatactggagttcggtgcacctgtgtatgaactccagcatattatgctggaccggtatactttgctgactccagtatcatatactggagactggagcaccggtggtccaaactccagtatattatactggacaattatacttgctggaactccagtatattatgctggagttcaagcatacttatgctggaactccagtataatatactggcgtatttttcgggttttgaacaatgttttcgctcagatttatctttacataaaaaatagctaaatttcgattacttttgaaactggtctatttttgaacaaccagttgtaaatctggctatttttgaatttctccttgctaaaaccgaaagtagactacttattccctaactgacatacttattcttaaaaaaatggcatacaacatttgatttccttgcaaactattattggttaagtaaagaataagaacggttataatttgaatattcaaataacaagcaagattggctaaatctatttatgttggctgtattagtttgggattgaaatgatctatttggaaaaatcttctcgtgtgtattaaaaaatttattcacaagttacaaatatttatgtgtttccctaagcaatttgttaggttgagaaagaggcaaacccgaaaataaaaaagataaaggacaccaaattttagtatgcaaaacccttcaaatcgaaggtaaaaaccgtgggatcgtaaagatccaaaaaagctccactataacaataagagggttacaaaagttttccaaatttggctacacaacaagtgccaaacacggagcaataatagtaacaagagcaacaactaatcaattgaagaaagtggagaatccacaaaaatgaagctgttgttcgatgctcaaaatcagatgctacgagcctccaaatccgatctccaccgttcaaatataagaccaagatgttacgaacactcaataaaatttcagcctcatccaacggttaacgaattggaaaacatgatttgaaattgtctggtcggaataaaactctgcagcaaaacaaatacttttcttctatcttctctcttgatgaaagctctctcaaaacccactcttatatgcttaagtctttcggaacttccatcaatgagcatagaataattctccaatgttgtcctatttatagatcatgagtggtgctttctcttaaagccaaaacccacttaaaatagaaataaaccgaatcaaattccaaatagaaatggaaaccaaaagagaataggattaggccattgggcttttggctggacaacatgggcatgtgcccaacaaactctccctcaagccaaggggacaaatatgttttcaagtagaggaactattgacaggcttcatgcctgccaattttctacaaaattcatgtttatctgcaaccaccgcctttgtcagcatatccgaaggattttcatcaatgtgtatcttctcaacatcaaataatttcttttccacgaccattcttatccaatgatactttctatttatatgtttggtcttagaatgaaaaatggagtgcttggtgagacagataacactctagttatcacaaaataagatgtaccttggctactcaaagcaaagatcattaataaactccttcatccataatagttctttggcaccttctgtgacagcaatatattcggcttctgtggtggatagagctatacacttctgtagtttagattgccaagaaatagctccctctgcaaaagtgatcaaataaccgtaagtggatcttaatatatcaagattgcctcctaaatcagagtctatgtaacaaacaagttcaggctttccattgccaacgcacaacttcaaatctgcagtacctttcaaataccttatatccattttactacatcccaatgttcttttccaggactaaaaaagaatctactaatagtaccaacgacatgtgcaatatctgatctagtgcaaaccataacatacatcaagctaccaacagcagaatagtaaggaatacgagacatctcctttttctcttcatcagtagatggactctaactaatactcaatttgaagtgtttagcaagagtagtactaaccacttttgcatctgtcatattgaacctcttgagtaacttctcaatgtatttcttttggcacaaaaataactcctttctatttctgtgtcagtggatttgaatgcccaagattttctttgctatccccaagtctttcatcgcaaacgttttctcaactgcttcttaaagactgcaattatggatttattcttgccaacaataagtatgtcatccacataaagcaataaaataataaaatcatcattagagaacttctggaagaatacacattggcctaaagaagttttcttgtacccttgttcttctatgacagattcaaacttcaaataacattgccttggagcttgtttcaatccatacaggctctctttcaatttgcatacataatttttttcccttagttacaaagccctcaggttgctccatataaatctcctcatctaaatcatcatgaagaaaagcagtcttgacatccatctgctcaacctctaaatctatgcttgtagctaagcctagaaccacacgaattgaagacatcttcacaacaggggagaaaatttcatcaaagtcaactccattcttctgtccaaaacctttaacaactaatctcgccttgtatctagtcgcagaggtatggttatcatgctttattatgaatatgcatttgttagataaagctctcttacctttaggcaattttattaactcatatgtgtcattctcatggagtgacttcatctcatcttccatcgcttcgatccactgatctttgtgagtatcttgcatggcttcatcataattctcaggttctcccatgtcagtcaaaagtacatactcttcaggaggatagcacatggatttttgcttctccctagatcttctaagagaggtttcaggagcattcgaagtagttacctgtgcaggaattggttgctgatctaccaaaacttcatcaactggagcatccataacatctacaccatgatgatcattttgatgttgatcactatcttcatcattgtcttgtgttccttcacgtgcaataggtgccttagcaattgaaaccggatcaatatcaactaagctttcattactctgcgaatctatctctcaactttgtcaatatcttcaatagtttggtcttcaaagaatattgcatcacgacttctaataattttattgtcaactggatcataaaaatgatacccaaactcatcttgaccataaccaataaagatgcactacttagttttgacatccagttttgatctctcatctttaggaacatgcacacaaactttacacccaaaaactctcaggtgatcataagaaacatctttggcaaaccaaactctgcctaggacatcaccattcaaagcaactgcaggagacaaatcgataacataggcaacaatgtaaagtgctttcgcccaaaatgtatttggaagtttagcctctaaaagtaagcatgtaactctctcaactagagttctattcatcctctctaccaaaccattcaattgaggcgtcttgggtggagttttttgatgacgaattccttgttccttgtaatagttatcaaagggaccacaacattcaccaccattgtcagcgcgaatacattttcatttcttccccgtctgtctctcagctaaggcatgaaattccttaaacacgataagtgcttgatctttagatttcaaaggatacacccagagcttacgagaatgatcatcaatgaaggtcacaaagtaaagtgcaccaccttttgactttactttaaaaggaccacacaaatcagagtgtactagctttaataaatcagactttcttgagggaggatggctataaaggaaacctttttctatttgccagctaaacaatggatacaccttttcagctttgtttgtttcactccagaaagcaaacttttcttagccaaacacgtaatctgcctctcgctcatatgactcagtcttcggtgccacaattctgataaagtattactttccaccagatttatggagtcaataagaatagggccttgtgtcacatataattgaccagacttgactcctcaagccactactaacgagcccttagcgagcttccattggccattaaagagggcattatagtaactttcatcgtctaatcttcctgcggagatcaaattgaaaggaaagtctagagcatgcttgacatcttgaagaactaatgttgaaccattattattttcaacaaactattccaacaccaaacactttaacatcactagcattgcccatctttaacactccaaaatcaacatgagtataagatgagaaaaaatcttttcttggtgtgacatatgggtagctccagaatctactatccacctcgtctcatgggataccaaattgatgacattttcatcataagcaaaaaaaggtcatctagaacaatagcaacaacattgttcttgttattttcagctttctttccttctctagtgtcttgattcaacttgcggcaaaaccttttgatgtgtcctttcttgccacagtggttacatgtaatattatagtatttgaaccttgacttacttctacttttacctctattccttgagcctcttgttctatctctcccccagttttctgtaaccaagatatctgcttgtgaggatgaaccctaagattttctccttacttcctcgtgcaacacaccactcttggaatattacatggtcaccttacctccatgagctggatttgtcaaagaaacacgaagagtttcccaaaagtctggcagagtattaagaagccaaaatccttgtatctcatcatcaaaattaactcccattctagatagctgatcaaggatgccctgaaaatcatttatgtgatcaaggatagggatggcttccttgtatttaaaggtcatcaattgctttagcagaaacaatttgttgttcccgatttttaaagcataaagagtctctagcttttcccacaatgatctcatatgtatctcgttcacaatatggttgcaaacattatcttcaacccattgttgtatatatccacatacttgttggttctcaaaatcccaatattcatcggatatactctcgggtttataagctgaaaaaacgggtagatacaacttcttcacgaacaacaagtctttcatcttgcttctccaaacattataacttatcccatttaaacatgccatattgctcatatttgcctccatttcataacaacccggataaataaccaaggctctgctaccactgttatgtcgaggaagaggcaaacccaaaaataaagaagataaagaacaccaaattttaacgtggaaaacccttcaaatcgaaggtaaaaaccacgggatcacaaaaatctaagaaagctccactataacaataagagggttacaaaaattcttcaaattggctacacaacaagtgccaaacatggagcaacaatagtaacaagagcaacaactaatcaattgaagaaagaggagaatccacaaaaatgaagctattattggaggctcaaaatcttacgctacgagcacttaatctgatctaaccattcaaatctaatatcaagatattacgaatattcagtaaaaatttcagcccgatccaacggttaacgaattgagaaacataatttgaagttggctggtcggaataaaaatctgcagcaaaacaagtacttttcttctctcttctctcttgatgaaagctctctcaaaacacactcttatttgcttaagtctttcaaagacttgtatcaatgagcgtagaataattctccaaggttttcttatttatagatcatgagtggtgctttctcttaaagccaaaacccactcaaaatagaaataaactgaattcaattccaaataaaaatggaaaccaaaagagaatagaattatgccattgggcatttggatggacaacatggacatgtgcccaacacaattggtaggtagtgtttgaagaaaagtctcaaaagaccataagttggaattgccttaaagatctgtgcttcaaacctagagaatcataatggaacatcttgtgtcatcccatagtaaactcagttgttgctgatactttattatcatttcctccttccacaactagagctcggacattgacaaaactattttgataatgtagcaaaaagttctagtttttatttacttgtttcttttaccttttgatgaaggtggcaaaagattctagttggaggtggcaatttgaaactctaactattgttgatgtggtaattaccttagtgttgatctaggaataatggtcttatgaaatttcgagagattttgttgacgtacttctcatgcattgcattcatttatacatgtatattgatccatgaccagatgacattatatacgtgtatatatatatatgtatatatatgtatatgggatatgagaaaggttatggtattatatacgcaccaccacctaatcagctcgtatacgttgataattttgcccagagtggccaagatgatatgatggggtgccctcaaaggcttgatgatgttatggacatatgtacctatgcacgacatgacattcatatgcatatgcatgacactataagtatttcatgatttacagagtcatcaagacttacaggttgagtcctttactccatgtttcttccatgctctttatatatttatttacatgccttacatactcagtacattattcatactgatgtcttttattggcgatgctacattcatgcatgtaggttagataattagttagacgagccctcataatagaccagattgacattcagcgaaagatcggtaagactccgcctcattcggagtacggccgagtctatgagtcatcgtgtcagagttttgctacagacttatgggtaggccggtaccttgtcccatttgattttaaaaaaaatcttagaggctttggagacagaggttcggtttgtacagtatgttagagcccttgtcggcccatatgtattcatattttaagaaagatagtttattgatacagtgctgcccatacattacaagttgtgtcatgttggcccatgatagttacaaaagaaatgaataagttacagagtggttcgctcgggccactagggcaccgggtgccagccaggcctccctaggttcggagcgtaacagagtggtatcatagcagttcgtgtcctaggaagtctgcaaagccgtgcctggtatagtctcacttataggtgtgttgcgcgccacatttataattgagaggctatagggcattttggaaatttttaccattcttttattttcagatcgtgccatagagctgagttataagaagttagtatcaagctttcactggattttgtatgcaccaggggtgcaggtatcacagtaaagctttaagacgtaatttccacctactataaccccaatgaaggaattagatttcgcaaaaattataaagagttcatatagaatcactcagatttctcaaacagtttcataagctataagattcatcaagtatcgctaatacaatttggtttaaaggaaatactagtatcaagattttaggcagccaatatttctcaatacgagcaagtctatgtaagtgaactaccaacacatgagcactccccatgttatttttttttatctatttctccaccttccataaaccaactttttaattaatttttctcaaccatagtgaagaacgagatactcaactacaaaaggttgtgaatagtcgagacttcagatatagtttgggttttattttagtttacagaagagaccctagtaaaaaaattgcaaatctctaagagttacattcgatgacgaatgttctaaaagggggaaagatgttacaccccgtaagtttaacaaccttaccattttatatatatatatttaatatgatattttgagtgaaacatttttgtaaaaaaatggtttgaaaaatataactttttatagttattaatattactactttcgtatatgttttaaattatacacataatatgataaaagtttatgagattttcttcattgtaaagatatgaattatttttttcacaagaaaagaaagtttttttttaaccattttaaaaattaagtatacaaaaatttatactctttatatgagattatgacaattataagttgagaaaatatatgtacttttatatggatattttaatgaaataatcgtgtatgtatttattttatatgctactacatgaccatgatagtaagttatataatgtgtgttaaaagtgagtgatattttaagtaagttgagataattcttaattatgcgggtaattggtaattatccaaaaataaatttggataagaacattacgtggcagccatgcaatagtcataagatgaactcacatcaaacaaaataatataatgcttgaaagaaattaagtttccatactgccaaagatttcattttgtgcaagctactttccaccttgaagtatccgaatgccacataatagaaccattgccccgtcgtccgccacgatatgctaatgaaactcttcatggtataaaatttcattgttttcttcccttcattgccttggttccgaacgacgaccactgtagcttatccaaattcaaaattcccttcctttggtgtccagccccacaaatgaattgattatgagttccccgcctgcattgaaggctaagtctgccaaatgatcagctacctcagctttattctcttgtatcaaatgacttggttgattttctgtagacctgttattgctcaaatttctgagacaaatcattttattagaagtggtatatactgcaatttttctcaagaatattatacggatttttcctactttgattcgccgttacgtgtttccgtaaaagagaaacaactcaagtatgttaagattattcattctttctttttggcatgatctatacgacacaaacgaaatgagcaaatacacaattttcataaattactgtattcgtagaaatgctagagatatgtatattcttattctcccacaagtcttattattctattatttgttcatgggtcatagaaaaactagagttatataaaaacatactactaaaccattgtgcgtgtatctgcagcattaaagaatggtgtttaacaaatcttgggttccgaaaaggaaaaaatatcacttaaatccgaaaagagttatatttaactaatactgtagatcacaggaagcttgttccacaataacttttggcttcaagaagcattaccttctttgttcattcttcgtataactcattgaacagaaagtcacatttagcctcaatcgtgctaaaaccgaaagtaggctacttattcccaactgacatacttattcttaaaaaaatggtatacaacgtttgatttccttgcaaactattgttggttaagtaaagaataagaacagttataatttgaatattcaaataacaagcaagattggctaaaactgtttctgttagctgtattagtttgggattgaaatgacctctttggaaaaatcttcccgtgtgtattaaagaatgcattcacaagttacaaatatttatgtgtttccataagaaattggtaggcagtgtttgaagaaaaagctcagaagaccataagttgggattgcctcaaagatctatgcttcaaacctagagaatcataatgaaacatcatgtaccgtcctattgtaaactcagttgttgctgatacattcttatcatttcctccttccacaacttagagctcggacgttgacaaaactgttttgagattgtggcaaaagattctagttggaggtggcaatttggaactctaactattgttgatgtggtaattaccttagcgttgatgtacgaataatggtcttatgatattccgagaaattttattgacatacttctcatgcattgcattcatttatacatgtacgttgatccatgaccagatggtgtcatatatgtatatggcatatggaaaaggttatggcggtatatacgcaccaccatgtaatgacccgaccggtcgtttcatgagttaccgctccgtttcccccattttgcttattattgccttgttcagttgtattatgtgctatcgggttggttggctcgggttcagaaaagttttggtaaggtttgagacacttagtctcttttgagtgagcttaagttggaaaagtcaaccaaaagttgacttatgtgctaaagggctcgaatgtgagttccgattgtttgaatagctttgggaggtgatttctgacttaggagcgtgatcgaaatgtgttttggaggtacagagtagatttaggcttgaattggcgaaattggaattttggcgtttcaaattgatgtgtgagattttgatataggggtcagaatggaatttcgggagttgcagtaggtctgttgtgtcatttgggatgtgtgtgaaaaaatttagatcattcggacgtgatttgatagactttttgatcgaaagcggaatttagaagattttggaattcttaggcttgaatccgatgcaaatttggtgttttgatattgttttgagcgttccgaaggttggaacaagtttgaacgatgttatgggatatgatggcatatttggttgaggttcctagggcctcaggtgagtttcgggtggttaaacggatgaaattgcatgttgagaagttgcagatttttggcttcagctgttgcaggtttttcttcttcgcgatcgcgtagggagtctcgtgatcatgtagggccttgatgggggcagttcaggttgtgcttcgtgattgtgtcatgaccccaaataccgattgtgatggagcctatcacatcactaggcaagccaaccaatcaactaaccacgacccattttcctttaacattaagccattttctaacacaagttttaaatactgaagtcattataagcgttaaaacaacagaaatatgcggaaggtcaagtaaaatcctttttcaactagtaacaagtaattgacacgtaattaaggtgaagcaaacaaatagatgttcgcccctcacaatgataacataaatacatggaagaacacccagacacaaccctaaccggggtgtcacgagtcatgagcatctataagtcataatacaagtctgttaaatctataagctagtacagatgtctgaaaggagataaagatgataaaggagtagagacacggggctgcaaatgccatgcaactacctcgaagtcttcgtcaaatactgaacagttgaaagccctcactcggccgctcgtgtacctggaactgcacacaaggtgtagggagtaacgtgagtacgcaaactcagtatgtaactagagtaaataagtactgaaagcagtgacgagcagttaaaaaatacataactagataatcaacataatatcatgtcatctttccagtttaaattcagttttcgttataaaatcacatttccagtttaaacatttggaatcaaatacttagcagaatgtcaaacagaggcttatataaaaaaagagtgaaataagtgaaaacatcataacaaggcctctcgggcaaggaatcactcagaatatggcccctcgagcagcctctcagtcactcgtgactcgactctcatcacacagtactcactttcagcactcggctcattagtatctcataataagagaaatcatagtaaccgctgcggcgtgcagccctatccataatttatagtcgactatgctcactatggggtgtacagactctggaggggctcctacagcccaagcgtcatatagctgcggtgcgcagcccaatccaatatacaattcgctgcggcgtgcagcccgatctatataagtatcactgcggcgtatagcccgatccataatatatgcatataatatcctcactattaggttctcaacctctctcagtcattaacctcacaacctctcgggcacaacaatagaacttagggaactcagcctaaacagtccttacaattagaagtggagtgataaaaccagtcttaaacttttaaataggtaaacaatgactaaggatatgctttcaacaaataaagtgaggaaaaacagtaacaatgcccctaaggatatcaacaggtcgacataaggccccaaacatggcatacaacccataatacagtagagataactaaagtacggaatatcataaggtttcaaatcaaatacgcggctcaatagtcgctacgggatggagaaagtcacaatccctattggcgcatgcccacacgctcatcacctagcatgtgcatcaccatatttatcaaaacaagtcaaataccgaggttttgtaccctcagttccagatttacaatggttacttacctcaaaccggtgaaatacaactccgcaacgcctttgccccttgaatcgacctccgcgcacgtcgaatctatccaaaatcagaacgaggatgtcaaagtatgccaagggaacgaagcccaagcgaaaacaatcgaaaaataccaaaaatcccgaaattactaaaacccgacccccaggcccatgtcttgaaattcagaaatttttaaattaatagattcctcgtctccccacgagtctatgcatatcaagaacactaaaattggagtccaaatgacccctcaaatcctcctttaaaggcacttaaactcaagccctaatcctctatttttagcccttaatctccactaaaaccatgattaaatagtggaaaaatgatcttaatcccaagtaattaagcttagggaacttacccaaccgatatcctttgattgctcttgagatcctatgccttagcctctttcccgtcttcaaaaatggagttctttgcaaaaattcgcgaaggaagcaatatataccttctcgcttctgcggttattcacttaaaggaccaacctcacatctgtggtcaactctccgcacctgcgcctttgcaggtgcggtcaaactaccgcatctgcgtttcctgctgttccctcaaaaatccgcttctgcggctcctgttctgcacgtgcggcatcgcacctgcggtccccaatctacaggtgcggaaataccagaagcagctgagattctgcaacttcacaagtctaaacctttctgtcaaccatccgaaattatcccgaggaccccgggacatcaaccaaaagtaccaacatatcctaataccttgttcaaacttttaccaatcatcaaaacacttcaaacaccatcaaatcacctaaaacacatcagattcaagccaaactttctaaaatcttccaaattacattttcgataaaaaacccaaccaaaccatgtccgaatgacctgaaattttgcacatacatcccaaatgacacaacgaaactactgcaactctcagaattccattccaactcctatataaaaatctctcttatcaactggaaatcgccaaaatatcaacttcgccaattcaagcctaaatcaattacggacctccaaaattcattccaatcgtgctcctaagccacaaatcacctcccgaagctaactcaaccatcagaactcacttctaagccctctaacacataagtcaacatccggttgacttttttcaacttaaacttccttaaaagagactagatgtctcaaaccttacccaaatttcttccagatttgatccgaccaacccgataccacaaaatacggataaagaagcataaagaagcaaaaatagggaaaacggagcggtaacccatgagacaactggccgggtcgtcacatattgtgtatcatgagtcgcgatcgcgtgacttaggcaagttatgaatcgcgaatgcgtggttctattcgcgatccataggtgtaaggtcttgtacatcgcgttcgcgtgggtctgtccacgttcgcgtagaataaatttggggtcttggaagcttgttctttgcgatcacgatgagggtcccgcgatcgcaattaaggaaatttaatagctaggcagaatttttaaaaggccatttccgcgattttgaacctaagttcctccatttttgggcgattttgaagctttttgaaggggattgaagagggaatcaagggggaacacttggaggtaagatttatggactttatactcaatcctaatgtattttctacctaattaatcatggaatttaagcctaatattgaagaactagggtttgtaattggagacctaaaattagggatttgagattcatggttggattttggtgattttgatatgaatgaactcagggaatgataaggagtctgttgatgtaatttttatgagaatacgatacgtgggcccgggagtcgggtttggccaaattcgagatttgtgttgtaatttgatttctttcgagtgggccttgttcctttagcatattttttatggttttgcactgattttagttagatttgaagcatctagaggccgattcgagaggtaagggcatcgcgtgatagagtttggactggattgaggtgagtaatgattgtaaatattgtcttaagggtatgaaaccccaaatttcatatcgtttgtgctatattgaggtgacacatacactagatgacgagcgtggggtcatgcaccattggggattgtgacttactctatcccaaatgactgttttaccgcgtatttgattgaaaactatttgctatcatcatgttttgggctgaatgtcatatttgggcctcgtgccaactatttggacccttaggggatttttactgttacttactcactgttttgattttatatctgtacttagtcatgctatattatactattttcataactcagccatgtttactctattttaacaattaaatgatattttgggctgagcatcatattttactgtgcccaagtggcttttagagatttctgactgagtaaggcgagggcctgtgttgtgaggattattatgggatcgggcttcacgccacaacagtgttattctgatttttattataaggccaagggactgagttgtacgctacaagatggcttgatatgaggtcgagagcctatttattatgccccgagatggcttgatattgcgcttgggccgtaaggggcccctctcagagtctgtacacgggaacccattgtgctgtgagatatagctcgaggggctggagttgttctgtgttattgtcagaggggctgattctattgatattgtgcccgagaggcggattttatgtgtttatcttttctagctgctttttatttatttgtttctgttgaaaagatgttttaaagaagcttataataaactaagatgttttacaaggtttcactattttactggttttactctgcctttctatagcatgttgttgtgctttacgtgatttcttatcgcttagtcttcatttattgttattactcactgagttggagtactcactttactccctacacgcggtgtgcagatttaggagctttaggtcccgccagtgagggttgattgctcccagtaggccattcggtttccactaggtagctgctcggcgttcgcagcccagtatttctccctcctatcctactttatgctcctagttctataatagactgtgtaaactctttcatacttgtagacttatgatagatgctcatgactggtgacaccccgatgtcaggctgtgtttattccacaaattgtattatttcactgtttctttgggatttaatcatgttaatgacttaaattgtgttactttaattgcttaaaatgaattgggtgttgtttcggctgaccttgtcttcacgagaggcgccatcacgaccatgtctaggtttaaggtcatgacaagttagtatcagagcctaggttacataggtctcgcgagtcattagtaggtttagtagagtcttgcagatcggtgcggagatgtgtgtatttatcctcgaggagctgcagaacctttaggaaaaaacttcatattctagaaattcttgtcatgcaaatttgttgatccgagtaataaacttctgttattttattctctcactgatggtgaggacacacactatcggtcaggatggatgaccaccagtaccaccagctgtggtcactagaggccgaggacgcggtaagggcaggggtgtggcctgcacagcagctagggcagcaattgcatatccaccagacgccccagttcaggatcaggtcctagttgtggatgctccagcagcaccagctcaggcaccagttgtgcccattgtgattctgggtcttcaggaggcctttgctcagattctatcagtatgcactggcctagctcaggcagtttcagttactatagtcgtagcgacttcttaggccgggggaggcacttagaatcccgctgctcgcacacctgagcaagtcgtgcagggacttcagacaccgggggcacatctagcccaactggttgcagctgctcaggactatgtagctcctgccatgccagtggacgagcagcgcaggttggagagatttggtagacttcatcctccgactttcagtggtgcagagggcgaggatgcccagggtttcttggacaagtcttagagaattcttcgtacaacgagtattctagagaccagcggggtcactttcactactttttagttttctggagctgtcttcacttggtgggaggcttatgagaggtgtaggcctgttggtgcagcacccctttcctggcagcaattctccattctctttttggagaagtatgtgccatagtctcgcagagaagagctgcgcaggtagtttgagtggttgcgtcaaggagagatgactgtgacacaatatgagataaggttcttagagttatctcgcatgctatttggttggtttcgatagatagatagaggattaggaggtttgttgatggccttacatatcagcttcgtattcttataaccagggagagggtgtctggtgctacctttgaggaggttcttgacattgctcgtgagattgagtcagtttgtcgctaggaacgagatgagagggaggccaagaggcctcgaggatcttgtagttatggtagtgctccttcgagaggttagtttcagcacagcagaggccatccattcaggcatgctcatccagatcgcccaggttatcatggggaatcatcgggtcatatttctcatagttatcgtcagggccagtcatcacttagtgcccttctagcacagagttcatcccgtactccattagtttagggctcttctatgccaggtgcatctgttagtcattcaagtgctaggggttcccttcagtccccatttccagcacccaagagttgctatgagtgtggaaagatgggccacatgtagaagtagtgtcctcgtcgtcttggggttcatctcagcaaaggagtcagccatcgtgtttagcgctagttacatcaccaccacccacctacccagttaggggtggaggtcggtcagctaggggtcaccctagagggagaggtcgattaggtggtagtcaggcccgtttctatgcacttccagctagacccaatgctgttgcttcagtcgccgtgatcacaggtattgtctcagtttgccacagagatgcctctatattatttgatcccggttccacttattcttatgtgtcatcatactttgctcattattttgatacgccccgtgagtctcttatttcacctgttcatgtatctactccggtgagtgatattattgttatagaccgtgtgtaccggtcatatgtggtgactatctagagacctgggtggatctattgttgttatgtatggtagacttcgatgttatattgggcatggattgactatctccatgttgtgctattttggactgtcatgctaagacagtgacattggctatgccgtgtgtgccacgtattgagtggcgaggttcgactgattatgtttctagtagggtaatttcaatcttgaaggcccaacgtatggttcggaggggttgtctttcgtatttggcctttgtgagggatgtcggtgcagagactcctagttttgattctgttctagttatgagggattttcccgatgtgtttcctgcagacctgtcgggcatgccaccggacagggatattgattttggtatttatattgtgccgggcactcaatccatttctgttccaccgaatcgtatggtaccagcggagttgaaggagcagcttcaagaactctttgataaggggttcattcagcctagtgtatctctttggggtgcgccggttctatatgtgaagaagaaggatggcattatgaggatgtgcattgattataagtagtttaacaaagtaacagttaagaacatgtatcctttgcctcgcattgatgatttatttgaccagcttcaaggagcgagagtgatctccaagattgatctccgttcaggttatcaccagttgaagatcagggattcagatattcttaagacggcttttaggacccgatatggtcattatgagttcttggtgatatcttttgggctgaccaatgccccaaaatgttcatgtatttgataaacaatgtgttttggccttgtcttgacagtttttcatagttttcattgataatattctggtgtactcgcatagtcaggaggagcacgcggagaatttgagagttttgttgcagagattgcgggaggatgagctttatgaaaagttctccaagtgtgagttttggctcaattcagtggcattcttggggcccatggtgtccagtgagggtatttaggttaatccaaaaaatatagaggcggttcagagttggccaagaccgtcctccgccacagatattcacagctttcttgatttggcgggttattaccgtcggtttgtttagatgttctcatctatcgcattgcctttgactaagttgacttaaaagggtgctctattcaggtggtcgaacgagtgtgaggagagcttttagaagctcaagactgccttgaccacaactccagtgttagttttgccatcaacttcaaattcatatacagtgtattgtgatgctttgagaattagtatagtgtgcgtgttgatataggagggtagagttattacttatgtttctcgtcagttgaagccccataggaagaactaccttgttcatgatttggagttggctaccattgttcacgtgttaaagatttggaggcattctttgtatggtgtgtcttgtatggtgtttactgatcattgtagcctccagcacatgtttaagcagaaagatctcaatttgcggcagaggagatggttggagttgctaaagaattatgatattactattttgtaccatccgaggaaggccaatgaggagatgtgatttccttaatttctagctctaatccctggaataataacataggaatgagttttaagtccaaatcccttacctcaatgaagtctgctggaatttcctctttcaaatcgcccaaaaagctcccaagccgaagtaaaaatggtgaaatagctaaatttcgcgaaatgaaataacttatatgttctgcctaggcctttctgcatctgtgttaccgcatttgcggacattattccacttatacggaaatcacttaatcggccacatccgcatctgcgatcatccgtctgcatctgcgactccgcagatgcggttctcttagacgcttatgcggtccctgacaaatccccataatccacttctacgaccacccactcgcacatgcggcaccgcacctacggtctccaaaccgcaggtgcgaaaacaccagaagcagcaatttcagcagcagcaataacatctcaacttctccgttaaccacccaaaattgccccgaggcccccgggacctcaatcaaaagcacaaacatcttccaataccttattcaaacttgttccaatcaccaaaacacctcaaacaatattaaatcacccaaaacacatcgaattcaagccaaacttcctaaaatcttccaaattacgctttcgatcaaaaacccaaccaaaccactttcgaatgacctaaaatttgcacacacatcccaaatgacacaacggaactactgcaactctcagaattccttaccggcccctataacaaaatctcgcctatcaaccggaaatcgcaaaaatatcaacttcgccaattcaagcctaaatctactatgaacctccaaaattcattccgctcacgctcctaagccacaaatcacctcctgaagctagccgaaccatcagaactcacatctgagccctctaacacataagtcaatatcttgttgacttttccaatttaaactcactctaaaaagactaagtgtctcaaaccttgccaagtcctttccggattcgatccgaccaacccgatcacatatagaaccgatagataaaataataagaagcagaaatagggaaaatagagcggtaactcatgagatgactggtcgggtcatcacatcatccccaacttaaactatgggtgttaatcgggctgggctgacccgttttcagcccgcttcaacccagttcagcccgctactgttcacgttgggacggtttgggatgagttgggatggggggcaggttgtgtacgttcacgtttagactaacggtgccccgaacccgttaaacacgaatttccttaacgggctgaacacgggctgcaacccgttagccgcccggtttccgtttgaaatttttttttaattaaattggaccgttcccaacggtcaaattcataaatgaccgtttgggaacgccaaaaaatgcagaaatggccaatttcagccccccccccccattaattaatatagccctcccaccttaaaatctataaatagccccccttcttcttcattttttctcacacattcacacattcactctcttactactctaattctctctcaagtatcaaactctcaattctctcttgatactatagtttttaaattctcaaatctcaaattctcaattatttattatttcaagtttcatcaattatttagtttagccattacaaaattattattatcaaatatcaattattcaagtaaagtgtggtattaattatcaagtattcaagtattatcaactatcaagtttcggtctatcaattgatgtttgaattttgatatcaaaaattcaaaattagtgcggcataaggaatcctggtacactcgttccatctctttatcttatttggtgtacacttattttattaattagtttcttaatttaatttcttaatttaatttcttaatttaatttcttactttaatttatatattggatttacttagagcggccaaaaaagcgtgcactaaaggtggtagtaagaaaactttaaaaagaataagaggtggtgttggttcttctagtagctttacatatatttctgaaagttcacctgaaaatttaaatgtagattatgagcgaatgcaagaaaattatggtgtagatgatgatttagatgctttgttagatgagattcaatcacccgataatcttgacacaccaccacctacacctggtaatgctagtcaaactcaaaatgttaggggtgcaagtgtaacaagtaggcctcctctcgctattaagaagaatcgacgattaaaaagtaagtgttggatgttttttgaaagactagaagatcaacaaaaatatataaaatgtaaaatttgtagtgaacattgtgagcacgtgattttttccctatatatgaataattcccaaaattccaacaaaataatttctctttattcttacaatttctgtgcatttcggtgtcattttttgataattgtcgcattttatttgcgcatgttaatttatataaaaaacaaaaatatgcatttcgcatttaggttttagttttattttttagtatcaattaagggttaatttgtttagaacaaaacatgaaaagcacaaaaaattagttcacttttgcatttttatgatttttattatgaatttgtcatgaaatagtattaaacaattttaggtattaattagttttaattttgaaatatatattaggactttattttggcaattttacaaaatcaaaaaatacaaatgaaaacaaagaaaaagaaagagtaaaattagaaaaataaaggaaaaacaattaaaatggaggtagtcttaaaaagacccagaagttgggccaattccgttcttaacccccagcccaaacggatcccagcccaatcacgcccaagcagtccagaaccctccggtccaaggtgttagattcaaaacgacgtcgtttggcgtcgattaattcaagccgtcgaggtcccatgatctaacggccaggaagcctaacaccttaatatatatatatatatatatatatatatatatatatatatatatatatatccgaaacattacccccttcccaccccagtctctcaccttcctcaccctacctctcatcttcatgaaccctaatccgcgccgcccctaaatccctcgccggcggtgagcgtcacttacaccgttcaaatccagattaacaccatagatcccccatgaatccctctttctattcccgttattagtttccctcgaatgttgtcggggctcgtcgaatcttcgattgaagtttccggccaggtcgcaagtttatccaaaccaacccaaaataataccacacaatccccagaattcccttaacccaaatccatgaccatcttccttcaaatctctgagaaggggctcgaatttcagatctaaatttctggccaaaaccctaaaccaaaatctttatgatttcgaaccgtaatatccttaaccatgtgttctcttgtaagaacatgtggttagggatgttgcgtgtcaaaaatctgtagagattcgaaaggcagtgcttagtcggagatttagctctgttgggtaagttttctttaactctctgaatcgttttcaatagtctcatactcccttatttggttagttggattgtttgtttatcgatcatattttaatgtcgttcatagataataatagttgttagtttaattagctagtattaacgttagttcatgctgatacactattttgattgccctgtttgtctctttctggttgtttaatgattctgagtttagatattagtttaatgttgacgattactctcgtttgattaatggattgttagaatatgcagtaggataagttgtattttgattcaattttgatattctgccttagagttggacctggttggttgtagttgagcaaatcttttgttttagttaactttagttagattttagctggggttaaagggattgggatcagttaaccttagtctgtaaattccagactagtagaagggcattttagggatagaaaagggtagtttcttttaggaatagtaatttcaaagtaagggcaagggtagtataggtatttggtgggtagaagagcatcctagggccttctagaatggtacttcagtgcagatgttggcatattagagggacttgcttgtttggcaagtcaaaaataaagggatcaaactgaaaataagggaggggctaaaagagaaacctaaaatctgattccccttcttgtgtcacctataagaagggcatcaagtgccttgaggaagggtcttctttctcagccattcttggactcaaaaacagttccttaccactagcctatttccagtaattcttgagttccaagtctgttagctaccactactgatttgaatggttttatccagttagattggatttctaatgttgactagaataaggggccgtgggtttaccaggttttcgatacagtctcagtagaaaaggttcttgaggggaaaagtgtcccggtccctagaataacagctgcaactgtcatggtagcctctgaaatgttgaaaaacgggtttttaccaggcaaagggttgggtgctgatttgcaaggtattgttcagccagtttatttgcccaagaatctagatacctttgggctgggtttcaagtatacagcggtggatgtaagacgagcccacaagatgaagaaaagaggctgggttcttcccaaaccaattccacgtctgtctaggtccttcgtcaggccaagtatcgggaagcaattattggcaaaggtgtctggtccactgactggtgtggataagaacttggagaaagggattgagaaggtatttgctgagttgaacatggttgaggccggggaagggtcgagcaaagcagatatacagtacatcgggccacatgctaatgtcaacaactgggaagccactcctcttccatctcgcagggagtcgcggtagtgggttttgttttccttttgttcacctggattattccagggtttgtaattcagtttctatgttccgtccgtttggatgagttaaaaccctgttatctttacattcaatgaaatgcaattccttttctttcttaattactaattttgtttccatttctttttccttttcttttctgtacagttctctttatgctgatatcgatgacatgacatgcatgaggaatcttcggcccagttttaaaagccaatctaattcagaaataatagtgcaagaaatcgagtgtcatgatgaggtggaatatgatgatgacaaggcctatgaggaagttagtcaagaattaagtcacttttaataaaaacccaaacctaacctaaatgacatagaaatagttaatctaggggacctagacaatgttcgtgaaactaaaataagtgttcatctggagccacagctcaaggtggggataatcaaagcattgttcgattgcaaggatgtttttgcatggtcgtatgatgctatgcgggtctaagtaccgatttagtggttcacaaattacccactgacccgacattccctcctgtcaagcagaagttgagaaagttcaaaacggacataagtgtaaagatcaaaaaagagattaccaagcagttcgatgcgaaggtcattcaggttacattgtatcccacctggttagctaatgttgtgcctgtgccaaagaaagatggcaagaccagggtgtgtgtcgattatcggtatcttaacaaggcaagtccaaaagacaattttccgctaacgaatatccacatattgattgataattgtgccaaacatgagagtggttcttttgtggattgttacgcgggttatcatcagattttaatggacgaggaagatgtagaaaagacggcattcgtcaagccatgggtaacatgatgctatcgggtcatgccgtttggtttgaaaaatgctggggcaacttatatgagggcagtgacaacaataatccatgatatgatacacaagtaaatcgtggtgtatgtggatgatgtgattgtaaagtctagacagcaatctgaccatgtcagggatttgagaaagttcttccaaaggcttcgcaggtacaatctcaagcttaatcctgcaaaatgcgcgttcggggtgccatctggaaagttgttggggttcatagtcagccgccggggtattggactggatccatcaaaaatcaaggccatccatgaatttccacctccaaggaacaagaccgaggtgatgagtttgctggggagattgaattatattagtaggttcatcgcccagctcacgacaacttgtgagcctatctttaagttattaaagaaagacgctgtggtcaagtggacaaacgaatgtcaggaggcgtttgataagataaagaggtatttgtcaaatccacccgtgttggttccgccagaaccagggtgacctttgattctatatttaacagtattggacaattcgttcggctatgtattgggtcagcatgatatcactgtaaggaaggagtaggccatctattacctcagcaagaagttcacaccctacgaggttaagtatactcattttgaaaggacttacctcatatctcgtttggacccgttaaagtatatctttcagaagcctatgcccacagggaggcttgcaaagtggcagatcctgctcacagagtttgacactgtctacgtgactcggactgcgatgaaagcacaggccttggcggaccatctggccgagaattcggttgatgaaaattatgaacctttgaagacttatttccctgatgaataggtgatacatgttgaagagttggaacaagttgaggagccaggatggaaacttttctttgatggggccgcaaacatgaaacgcgtgggaataggagcggttcttatttatgaaacagggcaacatcaccctgttacaactcaacttcgtttttattgtacgaacaacatggcagaatataaggcatgtatcttggggttgagattagctatagatataggtgtccaggaagtcttggtcatgggtgactcggacctactagtacaccaaattcaaggaaaatgggaaacacgggacttaaagcttataccgtaccgataatgtttgcatgagcattgtcaacggtttcagtcaatagaattcaagaacattccaaggattcataatgaagtggccgatgcattggctactccggcatcgatgttacaccatccagataacgcttacgtggaccctttgcagattcaggtccgcgatcagcacacttattgtaatgtagtggaagaggaacttgatggtgagccgtggtttcatgaaatcaaggaatatatcaggatgggtgtgtatccgatacaggccacaggtgattagaaacgaacaatacgatggttggcaagcgggtttttccttagtggagaagtgttgtacaaaagaactccagacctcgggttgttaagatgcattgatgcgagacaggccacatctatcatgactgaggtacattccgtagtttgtggaccgcatatgagtgggtacgttctagcaaagaagattctcatagcaggttattactcgctcactatggagcaggattgcatcagttttgtgcataaatgtcatcagtgccaagtgcatggagattttattcattctccaccatccgagttacatacaatgtctacgccatggccctttgttgcttggggcatggatgtcattgggccaattgagccagcagcatcaaacaggcacaggtttattctggtggccattgattatttcaccaagtaggttgaagcgaaaactttcaaatccgtgactaagaaagcagtgtttgattttgtgcactcaaatatcatctgtcggtttaggattccgaaggtaatcatcacggacaatagcgctaatctcaatagtcatctgatgaaggagacatgtgagcagttcaagattactcatcatcattctactccataccgtcctaaggcaaatggtgcggttgaggcagccaataagaatataaagaaaatactccggaaaatggtggaaggatctaggcagtggcatgaaaagttgcctttcgcattgttgggatacacaccactgtttgtactttggtgggggcgacttcttactctttggtgtatggtatggaagcagtgatacccgaagaactggaaatcccgtctcttcgaatcattgcggaggctgagatctacgatgatgaatgggtaaaaagccgccttaagcagttgagtttgattgacgagaagagattggcatcagtgtgtcatggtcagttataccagcaaagaatggcaagagcatacaacaagaaagtgcgtccgaggaagtttgaggtgggacagttagtgttgagacgtatttttcctcattgggcaggagcaaaaggaaagttttctcccaattggcagggaccatttgtcgtaaccagagtgttgtctattggtgcattatatctgacagatgtggaaggaaaatgtgtagaaatggccatcaattctgatgcgatcaagagatactatgtatcatttctttattttgattgtaattgtttgtatttggcatattttaaagattgaaatgacgaaggcgttttgttctgctatctaaacacttttaccccttgtcatcccctttgagccttacttattttctttcatatccctctttcggaatcaatgtcaccattaagaaacacgagtgcggaagaaaagaaaatgaaaagaaaaagaaaaagaaagaaaagtgaaaagaaaggaataaaagaagaagaaaattgaaaagtgaaaagaagaaagaaaagaaaaaaataaaaaggaaagaaaatgaagaaaagaaaggaaaagaagagcggaaaaaagagaggagaaaaacatcaatgtactctctatgacgtgaactacgtttgacttgatcccgaaagggtacgtaggcagcctctctgaggttcagtcataccaaaataaaatccaaaagtccccaagcaagaaactggggcagaagtcgtggttgttgtaagaaatctgatttcgaaagttgtaactttaaaccattttgaaattattttgagactttcatacactttttttctagccccgtccaaagcccacattacggtccaaagaaagaccttctgataaatctttgagaaatgccaagtcaagcaggtaaatgtaattcatgtctggggcaacactctggttcaagcaagaaaagcaaaaagataaaaatgagagagtcttattggtgaaaacctgcacagtcactgtaaagcaacgggagttgagagaaagaataaaatgagagagtcttattggtgaaaacccttgcgggcaccttgaggcgaaagtgagttgagaaattattgatggagaaaggtctgttggtggaaaattgtttcgaggcaccacaagacgaacaaggctaaggtttggataaagtaataaactgatggaaattctggggaaacaaagggtggcgaccaagagttggttagttggacagatttggccgattagtccgaaatgcatgtcatgacgattaataccagctgttccggtcagataagtttcgttccccttttctttttagcagtcatccaattttgtattcttctaatccctaactcataaactcattgcatttcattttctttgggggatttatctgtctaaaatgtttcaatgtcagttttgctcaaagcaagtggaaagggatttcaaaacttactaccagattccagaaagtgtaaagcgcgatgtggtcagagcatgtaaaaaataatgtgatgaaaggtggaatacagggaatcaccgaaaatgtcatcggtggaatgattgggaaatgtcgtgggaagtgcaaaggttcagaaaaagggtcagaggtgtgaaacaacaacatgggtacagaacactcggtttgtcagagtcaggggttcgaagatcagtcagaaagtcaaagcggttcagggccagttcgggaagccagtcggaacaaaataatgcagcagaaagatctccagcaagaatgccaccaactaaccaccattttaaactgacaaattttctttgattaaaataggggcagaaaagtttgtttgtttcagaggaactctttggagaaaggcagtcaccaaaaaggtttgctttttaattttcaggaccctcctggaacatgggacctagtttaaagttcaaaaataacataatcaagcataaacgtaccctaaaggagtataagttggtttagaagtgtgcatgttcgagacaggattcaattaggagtttctaggaccctcctgaataatgggacttagctttaagattttaattagataaccacttttagagtaaactctgttgtagggtagtgtaattcagacatgaaagttgtcacccttatgataaaatttgacctttgattttcaggactctcctagataatggtgagtagtttaaagatcctcttagatagcatgatttagcagaagtcacacctgtagaagatataacttagattttaatccgtcgtttagttaagagttgtcaggacccccctgaataatgggacctagctttcaaatccttagtaatacttggtaatatggtttagttttacaatcacatctgcccctagccaccaaactggggtagaaaagtttctttgttttgtctatttaaagtcaggagcccgcctgaagagtagggaatacatttcaagtcagcagtcaggagcctgcctggagagcagggaatacatctcaagatagaagtcaggagcccgcctggataacagaggaatacattcatgttcaagttcagcagtcaggagcctgcctggataacagaggaatacattcaagttgaagttcagcagttaggagccaacctggataatagaggaatacattcaatttcaagattcagaagtcaggagtccgcctggagaatagagacatacagttcaagtttcagtaatcgggagcccacccgtacaataagggaatacattcaagttcaacaatttgaagaaaggaacaacacctcaatttgtagtttgcaatggcaacaagggattttaccaagaaaacacaagacaacaaggcaacgaggaagtacaacaacaagtttgaagaatttagataggattttgtaattcataggtcatagtttagtttagcttcttttattttaccatggtgtaataaggaaggtcagcaagtagtagcagcagcaatcgcaatgaaatcatagctcctggtagtcccagctaccagacacacctgaactacactgacctgattcctgtttagcccaggatacgtaggcaaccatcgaagcagggtgcggtcaatttttttttttaaaaatgcttcacacggaatattcaaacgggcaaaaatcgctcattttcgctcatttatctttgcacggaaattcttcgtgtttccaggcaaagaggggaagctgtgagcacgtgatttttgcccaaagcaaattattcccagaaattcaaacaaaacaatttctttattaatttacaattttttgtgaattttcgtgtcattttctgttaattgttgcattttatctgtgcattttaattcatatgaaaaatacaaaaatatgcatttgcatttaggatttaattttatatttttagtattaattaggggttaatttgttttagaacaaaatatgaagaaaataacaaaaatagttcacttttgcatttttaaattgtttaattgtgagctcgtcccgaaatagtttgtaaaataattttagaaataaattagtttatttttgaaatatattaggactttattttatttgttgcaattttataaaatcaaaaaaatacaaaaaatatacaagatgaaatacaaaaaaaaaattagataaaagaaacaaatgaaaaggaaaaaagaaaacaaaaagaatagagaaagggctgcccacgatttaggccatgcccaagtgattcacccaggcccaaaccccttgacccggtccattccctcagctaaacgaaacgacgtcgtttcgaggggcgtcagatcaggaccattgaggtctcttgatcgaacggatgagaagtgtgggtcgttgagtatattatcccccccgtccatctctaacctaaaccctaaaaaccagccgcccccatatcctttcatcggagctcgccggcagtgaacgacacctactccaaattaccccaaaataacaccacgagacctcctcttctccctcatcatgaatccaccacccatttccttcaaatcccgccctagctcgtcgaatcctcgatcaaagattctccggccaaaacctaaagtaacccaatcaccaccaaatcaacaccatgtgaccgcctgggcctcatctacccaacacccatagccctatctctcgaatctacctggaacagctcgaatatcaaattgaaggtttccgaccaaaaaccctaatgcaaagtctccatgactttggaccctaacaaccctaaccaggtgttttcttatgaaaacacatggttagggatattacgggtcaaaaatttcgggggatttggagaaacaaccactggccggagctctttgttgttagtgagttcttgttggcattttttttatttcaattctttttccttttttgattttctgcatgtgtgaattccatagttaatgtctagtttaatttgcgttttaatttttgtcaatattgttctaatcttgtgtcctgatttttttgattaagtctagttgtttgtttgattttaatatgttccaattcctgatcttagtttgatttttagttaagccgttgataatttgttaattagttttactaagttttgtttgaattaatttctggtgttcctagtttaggttaattactagttagttcagtttcagtttaattagtcgtcgtttggtagttagtttggtcattaattctgagttcaatcgatagattcaacaagagtttaaattggggtatattcagagcttaagaaactgtcttagttagctgtagttttagtttaagttcagtggtagcttagacatttaggattgggcagcacatggcagttgaaactagaatcttctagggccttctagagtggtaatttagtgtagatttcaataatttttgtgggattacttgggtaacaagttagaaaataatggactaattgaataaataggtaagggactgacattgaaaactgaaaatctgagggctgccctcattggtgcttataaaagggcatgccctttacttcatggggaggtttttttttcagccaccgaattccccccaaaactctctctctctctctgaaatttttagatctgaagtagaaatttaaatttaaaaaaaaaacaaaaacaaacaaaaactcaacaaaaaaaaatcactatttcattggaaattgtatactgatgttgatgttctagttactaattcacatcctctagttcactctttgattgctgatgttcagaatggttgttgggtgatttcgagcagtttttgggtctaattagattgtgtttgattgagatttggttctgtgaaagtatgctgatacatttctagcataactgagtgcatttcaacggttttggtttaatcggcttgtttcatttgagttctgaaccttcctggaatttctggattcattttctgggttgtttgttgttctatactgctgaaaattgcttactgctactgttgctcgtgcgttgcttcagctgacttccaactcttctttgttttgtggtctaaatctcaggtacatgtcctgaatctcaaatcatgtagctgtccaattggaatgaaatgaaatggaagtataacttcattggaagcttcagttattgctgtgttttatcatagttgattgtagtagtttggactgtaattaaaattgttttacactgatttagattggtttggactgttaaactcatggactgtttgggacatttgatcatttgttagacatgttgtagtttaatttcatttggtgtagttaggttttgaaaaatcagaagttattcaaagcataaagcaatcttgtgattcacagtcctcactcgtcttaataattggcagtgtaatcctagagtcacattgtttgtatttagtaatggtaattgagagttagtttagagctggacgagtaatttgactgttggattagcttataactaattagcctagaatagtttgttgattaactctgttaaaagacataagtttggaaattgattctggacttgcatctttaattgataattggatatttgaattattgtggataattagttaaggttaattgaacaaggaactgaagcaaaactgggctaaacattattagcatagaattagtatagaatttcaaactcagcatgttctcaaggtccaactcgctggttggtttcaattcagcagggattgggccaattacttgagcccagaattgctaaagggtctttattaatatgttttgtttaagtaactctaattatttagggcctcttttgctttattcttagaaacaaaaatatagaaaatcgtacttgctttaggtttgtcatgtaattaataaaatgagatgagtctcgcaaaacaaaacacataaattgcgggggcctcaataatgttatatgaaaatatttagaattcaggagggtcgttcagcgaatttcacggttttccccaaaataataatacgctagactctttaagcacgactttaataaaattacgttcctaaacttgggtgcgcattgatgcgacccaaatccaaatctcaacggagtcaaaatgtgttgaaaaccacggttgcattgattgcgacatggttcgaaacacgttttcacgacgttgcaattcttttaaaataacaataaaagcggtttacgaataaaaagcacataagctatcatgtattaaaatcatataaaatcaaatacaatagttgagcgaccgtgctagaaccatggagcccgggaatgcctaacaccttctcttgtggattggatctaccggtcctgtgaggtcaaattctgtggtttcgagactagagaggatctcttgttgcttgatatgatcgaatttgagatcatgccgagcatggattaattatctccatatcacgtcgtcctagattgccatgccaagactattacattagcgatgcaagggtttccaaggttggtgtggaagggttccacagttgatacatctagtcaggttatctctttcctgaaggctcggcatatggtcgagaagggtgtttggcttatctagcttatgttcgggacaccaacgcagagtccccaatcattgattcagttcatgtagtccaggagttcgccgatgtgtttccttctgatattcctggcatgccaccagatcgtgatattgatttctgtattgatttggctcctggcacctagcctatatctatcccaacgtaccgtatgactccgaaagagttgaaggagttgaaggagcagcttgaggagttattagcaacgggttttgttagacctagtgtatcgccttggggtgggccagtgttatttgtgaagaagaaggatgacactatgcggatgtgcattgattaccgccagttgaacatagccaccataaaaaacatgtatccgttgcctcgtatcaattattcgtttggcttgttgcagggtgctagggtgctctctatgatcgacttgaggtcagggtatcattagctgaagatttgggacttggatgtatcgaagactgcattccggactagatatgaccattatgagtttttggtgatgtcctttggcttgactaaagccccagcagcattcgtggacttgacgaacagggtgttcagaccttatatttattcctttgtcatcgtcttcatcgacgacatcatgatatactcacgtagactgggggagaacaagaagcatttgagagtagtacttcagaccttgcgagagcaaaagctatatgctaagttctccaagtgggagttttggatagagtcaatggcattcatggggcatgttatgtcaggagagggtattaaggtggatccaaagaagattgaggtagtccatagttggccatgtcctactttagtgacccagatcaggagtttcatggtgttagcaggctattacagacgattcgtgcagggcttttcatctattgcatcacctctaactagatagggtgctcctttccgttggcccgatgattgtgaggcgagctttcagaatctcaagaccgctttgactacaacactagttcttgtgttgctttccagttcagggatgtatacggtatattgcgacgcttcacgcgttggactgggatgtgtattgatataggaggggcgagttattgcatatgtttcgcgtcaactgaagattcatgaaaaaaattatcctgtgcaagattttgagttggttgcgattgttcatgctcttaagatatggatgcattatttgtatggggtgttatgtgaggtttatactgatcatcgtagcttaaacattttattcaggcagagggatctcaatttgagacaatgtagatggcttgagttactgaaggattatgacatcaccattctttatcacccaggcaaggcaaatatggtcgtgaatgccttaagcaggaaagctgagagtataggtagcttggcattcattcctgtagaggagcgaccactagcttcggatattcagtccttggctaacagacttatgaagttggatatttcggagcacaaccgagttcttgcatgtgtggttgctcagtcttcaggttcattcagcctagtgtgtcaacatggggtgcatcgattctgtttgtgaagaaaaaggatggcacaatgagaatgtgcattgattttaggcaattgaacaaggtaacaattaagaacaagtattctttggctcacattgatgatttatttgaccagcttcagggagcgagggtgttctccaaaattgatcttcgttcaggttatcaccagttgaaggtcagggactcggatattcttaatacggctttcaggacccgatattgtcgcgacccaaatctcgatcgtgatggcgcacaacacactactaggcaagcccgaccattattcaacacttaacccaatttatcaaaaatagtggaaagaaatatcaattaagcaagattaaagtactgaagattttaacaaaatacataatataatctcactaggacccagtgtcacgaatctgagcctctagaatacagaatatcaccctaatacacggtatatccaaagtccgataatgcagaaataaagagataggataggagagagaagatcaatggctgcgaacgcagtgcagctacctcgatactcccagaggctggatctgctgatcaactagatctactgagcctgagactgccttggatttgcacacaaggtgtagggggtgaagtaagtactccgacctagtgagtaataaaagtaactacagtccgaaaataagaaaatccagtaaatacacaaagtaagctacaatccgaatatacaacaacatatggaactgagcaacccgagccatccatatttatttatcgtcgacggcgctcactggggtttgtacagactcaggaggggctcctacagcccaagcgcaatatcttggtcagtcattgttacatgatcggtcagccattgttatctgaccaatttatatcatacagtgccattgttaccactgttcaagtatatcatccagtgtcattgttaccactatttcaagtatatcacacagtgtcattgttaccactatttcaagtatatcacacagtgtcattgttaccactgtttcaagtatatcacacagtgtcattgttaccattgtttcaagtcactttataatcagtccagaaaataatataataagccccttgggcatttacaaaacagaagttcccagcccggaatacatttaaaaatatcatttaagttttcaacacttagaattatggctgagtttgcaaaacagcatttaaaaccttggactgaaattaaatgatatgcaaatcatgctaagcagtaatatcaatcctcgaaggatattacaaatcggtacaaggccccaaacatggcatcaagcctagttatatcaatgaagtatgtgtatcaattaccagtatagtataaacatcacacgggatggaccaagtcgcaatccccaatagtatccgaccctgcagtcgccatggagtgcgtttcacgcctcaatttagcgttacgatgtgaaagtccggggtttcaaaccctcagaacaacatttacatctattactcacctcaagatggcaaaaagtctactccgcgataccctttcaattcgaatcgacctcctcgtgcgtcgaatcttgccaaaaccacaaggaatatattacaataggctaagggaatataacccaatcgaaaagactcgaaaaatatcgaaaatcacgaaatttgcaaaacccgagccccgggcccacttctcgaaaaattacgaaagtcacatcaccggattcctcctctcgccacgagtccgtacatataaaatttaccaaaatcggagttcatttgacccctcaaatcaccaaatcttattttcaaatccctaggcctaaatcctcaatttttctacaattttcatactcaaatccatacataattgatgtacttaactcaaaataggtggggataacttaccttcacattgatgatgaaaatcccctcttgaagctccccaaaaatcgtccatactttgaagaaatgaagaaaagtgagctaaatccgtgtataaaagaatctgtctgtgcttcgttgagttgtaccttgcacttgtgctatacaagttgttacatcctattaaaattgttccttgtcggacaccttctgtttaaacacccataacgtcttgtataaatacccaaatgacaaacgatttgaaaatttagaaactagactcaaagatctttaatttgataggttgtacaccatataactctttatatatcctgagatacgagcttctaaagtgcatcataaattctgccgaaattgctccagcagccctttagatccatagtaactttctgagatgatatccaaatcgtgaatggtttaactttccaaaaactagaatgtatgggctacaaatttcgtgtttcgcactttttctgatttcttatagattacaagatatgtgcttccaaactggactactcgcacctaaaattttctgggcacaacagaattttctgcaatttttcccaagtctgaaatcacttcgagacacctccgaaacactcccgagccctcggggctccaaaccaaatatgaacactgactctaaaacatcacacgaacttgctcgagcgatcaaatcgccaaaataacatcaaaatcaatgatttaagccttaaatccaagaattctttcaaatttcataaactttcaaatttccaatttaaggccgaaacccgtcaaacaacgtccgtttgtaaccaaacattacaggaagcacttaaccaacatatatgacctgtaccgggcgtcggaaccaaaatacgagcccgataccattactttctgatcaaatttcattttcattttccttaaacattttcagaaaacaatttcacgaaaaaattcatttctcgggcctgggacctcggaattcgattccaaaaacacgttcaactcccatatttttctatggacctttcgagaccgaaaaaacacgggtctgggtctgtttaccaaaaatgttgaccaaagtgaactttaacaatattaaatatcaaaatttttcaatttttcccataattcatatatttcaacacaaagatattccggacacactcctaagtctcaaataacctaacgaagctatccaaaccataaaattcgcatttcgaatccgatatcaaaatttccacttccggccaaattttctcaaaaaccttcaattttccatctttagccgaacgactccaaaatgacctacggacctccgaattcacttctgatcgtgctcccaaatctagaattaccatacggagctactcccagtctcggaatcccaaacggacatcaataatactaaaatgcattttaaaccaaactgatgcaatttcttctaaaatgctatctttcacaataggcgccaaaacgctcccgggttaaccaaaacccgatccgggcatacgcccaagtccgaaatcatcatacgaacctgctggaaccttcagattccaattttgaggtcgtttactcaaaattccaatcctggttcattttttcaattttaagctttcaaaatgagaatttccatttagatttgactccaaacttcctgaattttaattctgaccatacacataagtcaatatatctgagatgaagcttctcatggcctcaaactactgaatgacacgccggagctcaaaacgaccggtcgggtcgttacagttattgtcattattagttcttcgtgatgtcttttgggctgaccaatgccccaacatcgtttatgaatttgatgaacaacgtgttccagccttatatcgattcgtttgtcatagtattcattgatgatattctggtgtactcgcgtagtcaggaggagcacgcggagcatttgagagttgtattgcagagatttagggaggagaagatttatgcaaaattcgccaagtgtgagttttggctcggtttagtgtctttcttggggcacgtggtgtccagggagggtattcaggttgatccaaagaagatagaggtggttcagagttggcctagaccgtcctcagccacagagattcgtagctttcttggtttggcaggctattatcaccgttttgttcagggattcttatttatcgtatcgcccttgaccaagttgactcagaaatgtgttccatttgtatggtcggacgagtgtgaggagagctttcagaagctcaagacaactttgaccacagctcttatgttggttttgccaatagctttaggttcatatactgtgtattgtgatactttgagagttgggattagtttattattgatgcaggagggtagagttattgcttatgcttctcgtcagttgaagacccatgagaagaactaccacattcattatttggagttggctgccatagttcacacattgaagattctgaggcattacctctatggcttatcttgtgaggtgttcactgatcatcgtagtcttcagcatttgttcaagcaaaaagatcttaatttgaggcagcggagatgattggagttgcttaaggattattatatcactatattgtaccatccgggaaaggaaaatgtggtggccgatgctttgagccgaaaggtagtgagatggggagtttggcttatattccagttggggaaagacctcttgcaattgatgtttaggccttggccaatcagtttgtaagattagatatttcggagcccagtcgggtgttggctagtatggtttctcggtcttctttgtatgatcgcatcagagagcgcctgtatgatgatccgtatttgcttgtgattaaggacagggttcagcatgatgatgccagggatgtgaccatcggtgatgatgcggtattgaagatgcaaggcctgattacgtgcccaatgtggatgggcttcggtagttgattcaggatgaggcccaaagctcgcggtattccattcatccgagtgccgcgaagatgtatcaggatttgaagcggcactattggtggagaagaatgaagaaagatattgtggaatttgtagctcggtgtctcaattgttagcaggtgaaatatgagcatcaaggaccgggtggcttgctacaacagatgaatattcctgagtggaagtgggagagaattattatggatattgtttttagacttccacggactttgaggaagttcgatgctatttgggtaattgtggatcggctgacgaagtccgcacacttcattcctgtgtgtactacctattcttcagagcggttggtagggatttatatccgggagattgttcgttcccatggaattccgatttccatcattttaggtagaggtactatgtttacttcgcagtattggtgagccatgcagagagagttgggtactcaagttgagttgagcacaacttttcatcgtcagatggatgggcagtccgagcgtactattcagatattggaggaaatgttgtgtgcttgtgttattgatttcggagggtcatgggatgagttcctaccacttgcagagtttgcttataacaacggctaccaatcgagtattcagatggccccatataaggctttgtataagaggcggtgcagatctccagttggttagttcgagcccggtgaggtcaagctattggggactgatttggtacaggatgctttggagaaggtaaaggtgattcaggagaggctttgtacagcgcagtcgaggcaaaagggttatgctgataggaaggttcgagatgtgtcctacaggttggcgagaaggttctgttgaaggtttcacccattaagggtgttatgagatttgagaagaaagggaaattgagtccttggctcattgggccttttaaggtgcttcggaggattggggaggtggcatatgagctttcttttccacccagcttgtcgagtgtgcatccggtatttcatgtttctatgcttcggaggtatatcgatgatccgtctcatgttttggacttcgacacagtttagttggatgatgatttgacctttgatgtggagccaatagctattttgggtcgtcaggtttggaagttgaggtcaaaggatatagcttcagtgaaagtacagtggagaggtcggcccgtggaagaggctaccttggaggccgagcgggagatgcaaagcatatatcctcacctattcgaggcttcaagtatgtttcttgactcgtttgaggacgaacgattttttaagttggggaggatgtgatgacccggccagtcatctcctgagttaccgcttcgttttccccatttcagctttttatgcttcgttatccgtatttttgaggtatcgggtttggcagatcgtgtccggaatgagtttggtgaagtttgagacacttagtctcttttaagaagtcttaagttagaaaagtcaaccgggtgtttaattatttgctagaaggctcggaagtgagttctgatagttcgattaactttgggaggtgatttgtgacttaggagcatgatcggaatgatttttggagttgtagagaagatttaggcttaaattggcgaaattgatattttggtggttccggttgattgtcgaaattgatattttagtggttcttggagttcttaggcttgaatcctaacttaaattggtgattgatgttgttgtgagcattctgaagctttgaacaagtttgaacgatgtcatgggatgtgttggtacaattggtatgaagtttggggagttctggctaggttccgggatgttttatgccgaaaatcatagctgtagcaggtccagaagggtcgcaggcctcggaacccacccacgcggtctgcacaaaaagaagtgaggccgcggtatgtgctttgcggaccgcacaaaatgaagtacggtcgcggtaggtgctgtgcagacctcacaaaatgcagtgtggttgcggtggagaacattccactggtcctacttcagaagctcatatcttttgatcaacaaggaattttgggatgattcaaaaacaaaggttgtatccattggtgtctagtttccagaaaagtaaagatatcagaatttggacatctgtagaaagagttatagccaaaatactaaagcctgtcactgtagagaaaagcctgtgtggccgtggtcatttttgtgcggaccgcggtcgattttgtgcggtccgcggaggtgaaaatctgtggggtactctataaatatgaggttttgggttttatttgatattttgacctagagagctcggattttggcgatttttcgaaggtttttcaagaaattcatcggggtaagtgattctaactcagatttggctatagtatatgaatctatcatcgcattcatcacttaattcgtgatttgggatggaatttgggaagcaaattctgaaatctttcaaaaatataaaatgatgatttgaaggaccaaatggtgtcggaattggataattttcatattgctagactcgtgagagtataaggattctagttttgtgaattttgtcaaattccgagatgtgggtccgatggtcgggttttaccaatttctggaattttgtggtaatttcattgttttcgcttgtctttgttcccttagcatattgtgacgtattcgttctgattatggatagattcgacgcgcgtggagtccgattcgaggggtaaaggcatcgcgagttagagatttcgccgattcgaggtgagtaatgattgtaaatgatgttgtgagggtttgaaaccccggatttgcacatcatagtgctatattgaggtgagtcacacgcttgatgacgagcgtggagtcgtgcactattggggattatgactaggtccgtcctgattgatgattttaccgcgtatttgactgaaacttatatgttatcatcatgatttgggctgcttgccatatttgggctttgtgctaactatttgaacccttcggggatttttattactatttcctcactattttgacttactaattgaactcagtcatgttattttccactattttactactcaaccatttttactcctttttgagacttaaatgatattttaaataatgttttgggctgagaaatactgttttactaatgcccgaggggcttgtgagtattttttactgagtgaggccgagggactagttttgaggaaacactgatactgatttgaggctgagggcctgagatatgtacgcgacgaggtggcttgttgatttagtttatgaggccgagggcgtgagatatatacgccacaaggtggcttaattgatatgacgtcgaaggcctagatttgatgccacgagatagcttgatattgtgcttgggccataaggggcccctcccggagtctgtacacccatagtgagcgcgagtacccattataatgtgagattgagcccgaggggctggcattgttttgagattgagcatgaggggctggtactgttgtgagatgttgcctgagtggcggttttgttgatactatgcccgaggggcaaacttttacttgttatttacctattaattacttattttacatgctgaaaaagggattttacttgattcttcactgattttaagtgatttttactgcttcggtataaaataccttgtattttacgtgttttcttactttcagtcattatttatatttattactcattgggtcggagtactcatattactccctgcaccgtgtgtatagatttaggcatagcaggtaccgctcctaagtgctgattcctctagtttcgggtggtttttcggagactacgaggtagttgttgacatctgcagccccgtttctctacttctatatcatttttgtttcctttcaaacacttgtaatagtttatgactttagcagactagtattatggtatagagatgctcgtgacttgtgacaccccggttagggctgtgtcgggttggaattccgatttgttatctctatttccgctaattgtgctattaaatcatgtttgaactattcttatgttatttaactacttaaaaggacaaaatctgttagactggttggccttgtcttcacgagaggtgccatcacgaccgagttcggggttagggtcgtgatagaactaaaaggataacaattggagtataacattgaagaagtcacttacacaagggacctaagatcataatgcacctttttgtgtttgataatatgctcaaacgagctagaatcttactctcgtctctaattcttggttcaattgtaattcttatacaatagattgaagtgctaagagtcccgaaattttataagaattaggggaaagctattgaagtatgtatggctaaaacccctcctcttagtaattgagcatccatggttcccgtataagtgttgtaagttcgaaacttgactgatgcaatgcttgttatgttaagtgaattgatgttgtgaaaatgtatgtggtaagtacttctttatgtgtttaatgttctattcttgtaaatggaagatgtggggataacatgatttatgtgctaaatgcctaacgatcatgccaaggttactttgaaactaacatgccaaacttgatgaatttccttctatgcttatgacctaaattgcttttgtatattcctatgactttaagtggcaaggtaaatgttgggaatgagaacaatgtgaaacttaagttatgaaatgtggaaattgtggccccaagcaccggtaaactaatgcatgtgtagccaaagattggagtgagatgaataacggaaagtggtaacatctcggggagacggcttagccgatcgggccgtgatcggatgccatgatatatatatacacatggtggtaatgtattgattattgaaaccggaaagtttgaatgaaataatggtaatgtcttggggagacggcttagccgatcgggccgtgatcggactccactcacagaagcggtggtaatatggataatgatgcaacaatgtgggattctccaatctaacattgtaagaactatgtaaaaatcatatgaacctccttatattgttggcatggtgcttattggaaactttgttgcctttaatatttcctcttcactctagaatggttgttctttctaacatgatagtgtttagttatacatacaagtactattccatggtactaacgtcccttttgccgggggcgctacatttttaaataaatgtaggtggctccatagtggatagtgccgatcgtatgtagcatagtatccttttctcaaaatcttggtaagccccttcctccttcaaggggtcatgttgtacaccttttgttatagacatccattttgaggtatagccgaggccttgttgccggcgttgttatcactgtcttttgtatccttagaggctccatagacatttgtgtgggttatgtatgggtattggataggtcaatgaaccatgtcataaccttatactcttgctttcttttaaactataactgtatggaatcttggacacttaactacgatttaatgttatgatataaaatgaactaaaatgttgaatgtactatctttccttgtctaaataaatgaaagcatggtttccttattcatattgagttcgatgggtagtgtttgataaggcttgctcagttgggttcactcgattgagcgccggtcgtgcctcccgaggttggggtatgacaaacttggtatcgaagcctaaggttttgaagtgtcctaggatgtctaggagccgtatctagtagagtccttcttatcggtgtgtagtcgaccacatctataagttggaggctactttggcatttaggaataacacccttctttgttattctggatcgtgcggtgaaaatgttccctctctaattagtgcattgttctatctttcagtaaatgacacttaagaagaaagcgagaattggccaaggagccaatgccacctcaggagtggcaaatgaatcattgcttgatattacgggtgagggtagttgccctactattaccctacctagtactcctattccaggacagactaccccagttcctgcacctgtgggggatactactatccttcacattgatactcctgtcccgcctccagccccaacttccggttctggtatctctgatgggaatcttaggggagctattcagatgctgactcagttagtggcctcccaggcctagaggtcaaatgctacacctagttcatctagccagtaaggggattccactagttctagggtaaacaaatttcttcagttagaccctctagtgttttcgggtgccaatcaagaagaggacgattaggattctattgaattagatgcacaagactccgagggtcatgcgtgcaactaagacagagggagtagagttggctgcctaccgcttgaaaggggtggcctatgcatggtttgagttataggaagaatcctgcgaggaggggatccctccggcgaggtggagtaagctcactgatgcttttataaatcattttctgcctgctgagacaagggtagcccatccagcggagtttgaaaatcttaaacagggtagcagaagtgtgtgggagtaccacatggagtttgctcgcctgtccaaatatgctattaacatgtttcccacaatagaggctagggtgcatcggtttgttcagggccttaatcctttgagtattaatgaggcttctacagctaccttgaattctaaaatgaattatgggaagatggtggtgtttgctcaggccacaaagaaccacaaactaaagaacataatggagagagagggtaacagaaagaaccaatctgtgggcaacatgggtgagtcactaggtgggggaataccagcttttcggggaggatcatcaggaccatcccagtctgttgcatagtctttagctagtgcaccgccatcagggccttgccagcagcaacagtggacttgtttcaggctcagtcagggaaatagaggatcctatcagcgggattggtcaggagagagaccccaacagcagcaaaggtccccatgccctaagtgcgggaagatgcatttaggggtttgctacttggagttacccgtgtgctatggatgcaggatgaggggccacattcagaggtattatcatgcatctcgccagggagcaggtaggggcacaacacattcatccggttcagcagttgctatatcttcagccccctctccagctcgaggtacccagcacccgtagggcgaggtgcagttaggggtgttgtgcagagttcagaagggcccaaccagttctatgttgtgagtgggttccagactgcaaaggcttccccaaatgttgttataggtattctgactatccaatctcatgatgcgtgtgcacttattgggatagaaccagagcagcttcatgaaccattttcgatatctactccggttggtgagtcaattttggctactcgagtttatagaagttgtgttgtcacgatgtgtggtatgaataccatggccgatcttattgaactagagatggtggattttgatgtaataatgggaatggattggctctattcatgttttgccaagcttgattgtcgaactagaactctgaggcttgagtgtcttaatgagcccattgttaaatgaaagggaggtaatgtagttcctaaaggtcggtttatttctgaccttaaggccgcaaagatgataaagaaggggtgtatctatcatttagtccatgttagggacaccgatgtcgaggcacctagccttgagtccgtacctattgtgaataaatttccggatgtctttcagatgagctccttggggttccaccagacatggagattgactttgggattgatgtgatgcaaggcacgcaacctatatcaattccaccttacagaatgacaccggcggaattgaaagagctaaaggaacaattgaaggattttctagaaaagggtttcatccggtcgagtgtgtcatcttggggcacatcggtcttgtttgtaaagaagaaagatggttcgttacggatgtgtattgactaccgacaactcaacaaagtcacaattaaaaataaatatccccttcctagaatagatgacttgtttgatcaattgcaaggtgctgtgtgttttttaaaagttgacttgtggttcgggtatcatcaattgaagataagggagcaggatattccaaagacagctttcaggactcggtatgggcactttgaatttctggtaatgtcttttgggctaacaaaagccccggcagctttcatggatcttatgaatcgagtcttcaagccatttctatactcctttatgatagtattaattgacgatattctcgtaaattcccaaagtcaataagatcaagctaaccatctcagggcagttctgcagacccttcagcaacatcaactgtatgttatgttttcaaagtatgaattttggcttgaatccgtaacgttcttgggtcatgtcgtctcttgggaaggaattatggttgatcctcaaaagattgcggcagtgaagaattggcctaggcctaccactccaacagagattcgcagtttcttagctttggctgggtactaccgaaggtttgtggagggatttctactcttacctctccattgactaaattgacccagaaagcagttaagtttcagtggtgcgatgcttgtgaaaggagatttcaggaattgaaattaagactgactacagcgccggtgttaaccctgctagagggtatagagggatttgtggtatattgcgatgcttctaggatcgagcttgggtgtgtgttaatgcaacatggcaaggttatagcctacacttctagtcaactcaagaatcatgaaaagaactaaccaactcatgacgtagagcttccggcagtggtgtttgcgctaaagatttggtgacattatttgtatggtgtccatgtggatgtatttacggatcacaagagccttcaatatattttcaaacagaaggagttaaatttgagatagagaagatggctagagttactcaaggactatgacattgatatcttctatcacccgggaaaagctaatgttgtagcggatgctcttagtcaaaaatctatgggaagtttggcgcacttagaggcatataagaggccgttggccagggaggttcaccagttgtctagtttgggagttctccttgcagactctaatgaaggaggggtgattgtacagaatagggctaaaacatcgcttgtggcggaagtgaaaagaaatagttcaacgatccaatgttagcacaattgaaagaggggattcataaagacaagaccacagctttttcccttggcatggatgatggtaccctatggtaccaaggccgcctatgtgttctaaatattaactgtctttgggaaaggatcatggcagaagctcatacttccaagtattccgtgcacctaggttctacgaaaatgtattatgttctcaaggagtttattggtggaataacatgaaaggggatgtggcggactttgtggctagatgtccaaattgtcagcaagtgaaggtcgaacaacaaagacctagtggattggctcaaagcatagaaattccaatgtgtaaataggagatgatcaacatggattttgtggcagggtttccgcgcactccacacaagttcaactcaatttgggtgatcgttgatcgactaacaaaatcagcacactttttgccaatgacatctactgacacggcggaacaatatgctcagtcatatatcaaagaaatagtcaggttgcatggcactccagtctcaatcatttcagatcgaggggctcagttcactaccaacttcttgaagaaatttcagcaaggtttgggtacgcaggtaaatcttagcacggccttccaccctcagatcgacgggtaagaggaacgaactattcaaatgcttgaggacatgttgcgtgcttgcactcttgatttcaaaggtagttgggatgaccattttccactcatagaatttgcttacaacaacatctttcatgctagtatccaaatggcgccatttgaggcattgtatggtaggcaatgtagatctcccattgggtggttcgaggttggagaagctaaattgatagggccgaacctcgtgcatcaggctatggagaaagtcaagattattaaagaatgactgaaaactgctcagagtcgccaaaaatcttattcggatgtgtgtcacagagatttggagttcaacgaggatgattgggtatttttgaaggtttcccccatgaaggatatcatgcgatttggaaagaaaggtaaattaagtccgatgtatgtcggatcatacagaatcattcagagtattggtcaagtggcatacaagctcgagctgcaacccgatatgtctttggtacatccagtcttccatgtgtctatgttgaagaaggtagtgggagatccgtccattattgtgccaattgaaactactggggttaatgaagaactgtcatatgaagaaattcttgttaccattcttgacaggcaagtccggaagttgaggaataaagaaattgcctccgtaaacgtgttatggcggaatcggcaagtccaagaagccacttgggaagccgaggaagaaatgagaaagaagtacccacatttgtttgaatagtcatataaatatcctctatgcatttgattcctatgaactcttatcttttgacttgatctatgtaaaactattctattttggttatatatattgcttatgtggctatggttggtgatgtacaagttatgttgtgtctatggaacatgtatatgctgttaggatatgtatcgggggccctctgacaggtagataggcctagttacaaaggaaactctgccaaaatttttggaaattttgggagttaaccaaatttagggctgtggatatgtttcatgttgtgaaaagctgaggttgcataaacattccgaataagtgagccctgatcctcgtttgaggatgaatgatcttaagtgggggaggatgtatgtccccgtgaatatttctactcaaaaacctgaatctcatggtgctaagttaggagcatgtgttagaaattcataaaattcttcgcggctagcttgcttgctgcggttcagacccttttaaaccgatctatgcacaaaaaagtcaagaaataatattttccagaaaagtgtgattctgcagttgggaatgtggtcgcatatcaggtatgcagactacagggtcgccgcaaagtgagtcagtgtgttggtcaaatttgaggtcaactatgggtcaattatgcgatcgcataaccgatatgcggaccacatagtcatcgcataattcccttaggattttgtaaggagtagttctgcggtgcattatgcgaccgcagaataggtatgcggaccgcttctctgccgcatacccagacaatatgttcaggttttggggagcaaatttgtagtccattatgcaggccgcatgtcaactttacgatcgcaaatgcgatcgcagatctgactcagggctcctattttctaatttttaaaactcgaacctattccattaaaacaccatattcaatattctctatgtcatttttactgaaaatagagtgagaagaggagttctagagagagaaggggtgaccttcgtctaatccccacccaactcttaccccaaaatcttgaagattgtcaagaaagttgctaggtcttcaccctaaagaggtaagaacttgttccataatctgtaatttggggattctatttaaaaataggtgattaacaattgagttcttgggtaagagggttaatagtcttgcatgtataagggccaatggggtatggggaagataagaactaaaaggataacattcagagtataacattgaaaaaatcacttacacaagggacctaagatcataatgcacttttttgtgtttgataatatgctcaaacgagctagaatcttactctagtctctaattcttggttcaattgtaattcttatacaatagattgaaatgctaagagtcccggaattttataagaattaggggaaaactttattgaggtatatatggctaaaaccccctcctcttaaaaattgagcttccatggtgcccgtgtaagtgttgtaagttcgaaacgtgactgatgcaatgattgttatgttaagtgacttgatgttgtgaaaatgtatgtggtaagtacttctttatgtgtttaatgtgctattcttgtaaatggaagatgtggggagaacaagatttatgtgctaaatgcctaactgtcatgccaaagttactttggaactaacatgccaaacttgatgaatttccttctatgcttatgacctaaattgcttttgtatatgcctatgactttaagtggcaaggtaaatgttgggaatgggaacaatatgaaatgtgagctatgaattgtagaaattgtggccccaagcaccggtaaactaatacatgtgtagccaaagattggtgtgagatgaataacaaaaaatggcaacgtctaggggagacggcttagccgtcgggccatgatcggacaccatggtggtaacgtattgatgattgaaactggaaagtgtgaatgaaataatggcaacgtctcggactccgctcacagaagcggtggtaatatggataatgatgcaatagtgtgggatgctccaatctaaaattgcaagaactatgtaaaaatcatgtgaacctccttatattgttggcatagtgcttatttgaaactttgttgcctttactatttcctctttactattgaatggttgttctttctaacatgatggtgtttagttatacatacaagtactattccatggtactaacgtcccttttgtcgggggcactacatttttaaatgaatgtaggtggctccatagaggatagtgtcgatcgtgtgtagtagatcatccttttcccaaaagcatggtgagccccttcctccttcaaggggtcatgttgtacaccttttgttatagacatccattttgaggtataatcggggccttgttgccgtcattgttatcactgtcttttgtatccttggaggctccgtagacatttgtgtgggttatgaacgggtattggataggtcaatgaaccatgtcgtaacctttgctttcttttaaactataactgtatggaatcttggacacttaactacgatttaatgttgtgatataaaatgaactaaaatgtcgaatgtactatctttccttgtctaaataaatgaaagcatggtttccttattcatattgagatggatgggtagagtttgataaggcttgctcagttgggttcactcaattgagcgccggtctcgcctcccgaggttgggccgtgacaaacttggtattagagcctaaggttttgaagtgtcctaggatgtatcggagccgtgtctagtagagtccttcttagtagtgtgtagtcgaccacatctatacgttgaaggctacttgggcatttaggaataacacccttctttggtattttggatcgtgtggtaaaactgttccctctctaattactgcattgttctatctttcagtaaatgacacctaagaagaaagcgagaattgtccaaggagccaatgccacctcaagagtggctgatgaatcattacttgatactacgggtgagggtagtcaccctactatcaccctgcctggtactcctattccagaacagactaccccaattcttgcacctgcgggggatactactatccttcccattgatactccagtcccgcctccagccccagcttctggttttggtatctctgatggggatcttaggggagctattcagatgctgactcagctagtggcctcccgagcccagaggtcaaatgttgcacctagttcatctagttagtaaggggatttcaccagttccacggtaaacagatttgttcagttagaccctccagtgttttcgggtgccaatccagaagaggaccctcatgattttattgaatgagatgaacaagactctgagggtcatgcgtgcaactgagacagagggagtagagttgtctgcctaccgcctgaaaggggtggcctatgcgtggtttgagttatgggaagattcccgcgaagaggggagccctccggcgaggtggagtgactcactgatgcctttatagatcattttctgcctgctgagacaagggtagcccgtgcaacggagttctaaaatctgaaacagggtagcataagtgtgtgggagtaccatatggagtttgatcgcctgtccaaatatgatattcacatgttgcccacaatggaggctagggttcgtcggtttgttcagggccttaatcatttgactattaatgacgcttctacagctaccttgaattctgacatgaattatgggaagatgatggtgtttgctcaggccacaaagaattgcaaactaaagaacagaatggagagagagggtaacagaaagacccagtctgcgggcaacatgggtgagtcactaggtgggggaagaccaacttttcggggaggatcatcggaatcccaatcggacattgataacgctgtaatgaacttcaagccaaacttaggaaatttcttccaaattgttaacttccacaatatgcgctaaaatgcttccgggtcatccaaaacccgatccgggcatatgcctaagtccgaaatcatcatacaaacctgctggaaccttcatatcccgattcctaggtcgtgtactctaaaatccaatattagttaattcttctaacttaaagcttccgaaatgagaattatctttccaaatcaactccggacttctcgaaattcaattccgacaacatgcacaaatcataatacctaaagtgaagctgctcatggcctcaaactgctgaacagcgcgctagaactcaaaacgaccggtctggtcgttacattctctcccatgtaaacatacgttcgtcctcgaatgtgctgagaacaacactgaagtagtctgaaatcactgtttaaaatctcatgcaccttcccgtgctaccacaactcagttgggcacattagctcgatcaactctgaagatattcccttttattcaagaaaataagccttagagcccaattccaacatccagaattttatgccatacatgttctaacatacgctcaccgaatcgataaccgcatgcagcaccaagacatggctgcataccttagccaaattcacaccttacaccattttactcataggaccacaataacattctctaatcaatttcatcgaaattccatgactcggatgctctcattacatctcatgacatacataagtcttgctctaactcttacaataccgacacgacggatgagatgtgaagaaattcataaccactgccgaaataataattcattggcctatactcctggcaagaattatcacctcattctgaactaaacaatggccttagctccttaatatacttcatataactagatttcactgattccgaattcaaggatcccatctcacctagtacgaactcgtcaggcaataagccaccccggacataatcgaaagtctcatatgatgccacaatgtgccaataggctaccaattcaaacgcgatacaaaaggaaactactctgaaagggaaatccaattaccccgctcctgaatcatacatgcgacacggtcaacatgctaaataggcaccccgctcgcgaatcatacttgcgatgcggccaacataattaaacaaacacccgctcgcgaatcatacatgcaactcgggcacacggctaatatgagctttcctcaccaaaaataggaaaccaaacacataaaaatagatacggggaactatactcagcatcacactgttgcagcgcgtaacccgatccaaacaacataaccgtggcggtgtgccacccgatccacccataaaactcacataaagagatacaaaccgagctagattgctcatttcaataaattaccaaatatcggtcactagcacactaagtgcataatttcatccatcctgaggtgcgatatacgatctgaatctcaaagccatcctgctcacataacatcatctctacgcggaatctcagcacatagaaaattcagcaagccgtcccacaactcgcacgacacaatacatcattacatgaaatagctgacgacaaaacaacacctcgactactctttcataaggagcactttgttgaaatgaacatatctggcctgatatagagcccatactaacgtttaaatccatccacagacctcaagtcgatcctgatcgtaccaaaataggccaataacctttcgaaggtccatactaacttcccttttctcataacatacaagaacaactatcacaaccggagtactcctccacagccaacaacccaataaaccaagtaccctccaagcataaattctcaatttaaagacatcgccacaatcttcatacttggtttaacttctttaataaatgaagtgactacatgccacacttaaacaaccttcccgtggggcacgctcccataactttccgtaacaggtaacatgtctgtacatccaaaccactggccgcactaacattgaaaagcgattaagaatccttaaccatgatgcaaggcctctttcataaaacaccaatctcaggtgatgctgaagataataccaacttaccttaaacaccgaaactcctttcctgttgatccgagttcgtgacatccctgtcaacacagaactgcaaccttgatcctcacttcaaatcccataccactcactgcacccaacatgccaatatacaatataacatgttttttcatcataacatcggaaccactaatagattaacacttcatcatataaaaacttttcacttaactcatttcaggagaaccgtagcaatatacaggtgaattctcataaccgtggaatatgcaaatctctaagtagcggactaagccaccatagcccttccaagatcagcctacacataacagaccataacagaagaatactactgaacaatataaattacggcggcaaacaagcctcacacgttccgctacaaatcacatgcataacttgatcacgttgaagggactgatctataccaccaacatgccaactcaactatggttaactgatctatcttcttttgatttaccctgatttccttagaaataataataactccattcaacatataccatactctatccgcactcatcctgagtgaccttgaatcataagaccatgttgtcttaaaacccacaaaccatttcatacctcccaaatggtacactgcaagccaacacatcatagaacattctcgacctcttttcataagctgttacagtagcttgactcttaaccgtacctacaggctcaaaatcattaggcaccacactttacccctatgaatctactaggatcgttgttgagagccacccgctctgactcgccctcgaatatatttaactccatgaatcttccatcacatgaataccctctcggcaaagcacccggcagaatcactcccctttaaacgcgcttctatacaaggcataaatcctgaatacttccccaagtctgaacatgtgccaataaggacaaccatagcacacttgttaaagaaattaaaaatgggaaaatggtaattggtgtaagtggtcggcttgcctagctttcactagtacgcgccatcacgacccccgagggtgaaaaatccgggtcgcgacaaaatttgttatcatcttttattttttgtttttagatctttctaacatttttttcaatatttattttactttatcttattttctgatgtcattatttcttttttttacaaaaaaataatttatttcactataaaaggatgagttttaataaaaattgtctacataaactttaataaatatttttagtctttggttgaaattatttcatatttttctgttggctttatctgatcagcctaaataggtgttatcggtatatcatctatttatattagctataaaaagtaaacaataaatatggtcggaaatcatgtaaatattccataagatttcatttttttgagtttatccattatataacttctattataataattttaaaactctctattaatgttcaaaaaaatcttatctttttattatctttgaaataaaaaaaataaagagttttttcgaaataatttgtttacatttaaaaaaaatcacgttatatcaatttttgttttatatatactctttgttacacttaaaaacctctataaaaactatcaattagaaaccaatttctctcttgttgagtttgaaaaaaaaaacctttcacataatctaatgattcaaaactaatattcttcaacgaaaaaatattatacccttacaatattggcctgactatagttaaatgaaggggtttcatcttatacccttcaattccttgaatgtgctaaattgaaattaatgatagcaattgtatagacaaaattttgttatttatgtctatttatgcaaattgactcttcaaataaatattcttcaagaaaaaaaaaacaatttcttttaatattgattgattttgtgatgtttctttctccagtatgtatgtttactttataatatatgtaagtgtcacggcccaaattccattatgagtcatgatggcgccagatactgctgtcaggcaagccaaccaatacttaattaaattctcgttttaataattttgaaaactatgattttccttcaattttaccactaaaagataatcgtttcaaatcaagtatgaatgttaagaagttaatacaagatacccataatcatcctagaacccggtgtcacgagagcatgagcatttactagggaatggaataaaatacagtaactgtccggaatacaaagtgggcagaaatgaaaaacacagaaaaatactatgagtagggctctcccgggtcgtctcgataaatgcagctcacctaagtctccgtatcaaccatgccgctatgacactaagccactagccacatatgaacctgtgcaacaacaatgcatagcaagtgtagtatgagtacgaaaacaacatatacccaatgagtatcccgtctaatctcgaagaagtagagacgagaggtcgacttcgacacttactaatggtccaatgataatatagcaaaagtgtgaggaactcatggatttcataaagcaaaatttaattcataaggccgaaaagcaggtaaagaacttctcaattaataaaaggtttcgaaggatttacttttcattatctttattaatttatgtctggcaaggaagggcaattatcaacatttaaaattctctggcaagcaatacaagaatgcgcatatcatgccgaggtcatatggcccgatccaacataaatataaaatgtgcaatgcggagggtcgaacggcacgaaccctagatgaatctattatcccgctcgtgaatcatacatgcgatgcggtcaaatttaaataaacaatcaccttgctcgcgaatcatacatgtgatgtacgtacacatagacttacatgctcaaacaaccaattgagaatttatcggagaaagtttatccaaacaaaaccaattctcttttagcgatttaagaaaatgaagtttaatctttttattaaaaattcatttaccgattcgataggatttaagcaattcaactgccaacaaaattatagatattcctagtatagcatgcttttgggttctagactacccagacttatatataatagtagctacgcatagactctcgtcacctcgtgcgtgcgtagccccccacaaatagaagcacataaccaattattacacccatggggacaattccctcttaaaaagttagaaaggagactcacctcgctccaaagatccacaaccggcattccacgcccttccggagactcgaatcgatgctaaatgctccaaactagccaacaattatgcaaatccattagtatatgctcaattactcattacaatcaaatttataaaaattcccaatcccgatcgaaaagttgacaaaatttccctcgggcccacatgcccggattttaaaatttctcaaagataaagtttacccatgaacttacgaactcaaatatatgattttctcctaatatcatacccaaaatagtggtcaaaatccaagaatatcaattttctaggttttcccttaaccccaagtttctacaaattttcatgctcaaatacctaacaaaaccatgtatttaactcacaaggggtgatattaacttacatcatgtttgatgataaaatacctctctcgaagctctccaaaaatagcccaaacaagagtaaaattataacgacccgaccagtcgttttgagctctaatgcgtcgttcagcagtttgaggccatgagcagcttcacttcaggtattatgatttgtgcgcatggtcgcaattgattttcgggaagttcggagttgatttggaaagtgaattctcatttcagatgttttaagttgaaacaattagctaagattggatttttgagtaaatgaccccgaaattgggattcaaaggtttcagcagcttcctatgatgattcggacttcagcgtatgcccggatcgggttttgtatgacccaggagcgatttggtgcctattgtggaagttagcattttggaagaatttcataagtttgggttgaagtgcatttcggtgtaatcgatgtccgtttgggatttcgagtatgggagtagctccgtatggtgattctggagttgggagcgcgatcggaagtgaattcggaggtccgcgggtcatttttgagacatttggctaaagatagaaatttgaaggttcttgagaagtttgaccgaaagtggacctttttgatatcggggtcgaaattcgattccgaaagttggagtaggtttgtaatgtcgaatatgacttgtgtacaaactttgaagtcaatcggatgtgatttgataggtttaaatatcgaaagtatatgtttgaaattctaaagttcataaagcttggattggtggtcgattcgtggttttagcatggtttatatgatttgaggcctcgagcaagtccataatgtgttttggactgcttggtatgattggttggggtcttgggggcctcaagtggattccgtgtggttaacagaacgaaaatggaatttggagaagtgttgaagcatctgcttctttcataaccgcacctatggttggtcaaccgtaggtgagagaccgcagaagcggtcgtagcctcgtagatgttgcccagagctagccaagccaaactgcagaagcggctccttagcagtagaagtggcttcatgaccgcagaagcggtcccagcccttttagccaattccgcaaatgcggtcccctgaccgcagatgcggaaactgctgaagcagtcaacttcatttaagtcgagccaaccaattttgaccatttggcactcgggtattgagagattttggagcttttgagaagggatttccacatagcattgtgaggtaagttcatcccccttatatctaagtttgacactcgagtttttggtaaattaactcctaaagatttggagaaatcaagggttagagctagacatagggttttaataaaacttagattttaccacgaaattggttatgaaatagattagaaatcatatattatttatccttaggaaccttgcatttagggttgggaaattggtttacaaattagaatatgaatttttgagcatgtattggctagttattaccttatttgaatagttttggattgttcggctccaaattggaggttgagcgcgttctttagtcggaatataggcttcggagcgaggtgagtcttctttctaaccttgtaagagggaattgtccccataggtaatataattggttatgtgctcctatttgtgggggctacgtacgcacgagatgacgagagtccgtgcgtagctactattatgtttaagtccgggtagtctaggacccaaaaacatgctatacttggagtatttgtaatcttattgacaactgaattgcttaaatcaaatcaaattagtaaacaaatttctaaaaggatttaaacttcattttcttaaattgttaaaagagaattgttttttctttggataattgttccatgttgatttcttgattgactgtctgtgtgtgtttatctttggaactgatcgaacgcctcggtagattaaatagatgcatatatggttcgtgttgttcgacccacgacagtgcaccatttaaatattgttggatcgggttgtacgacctcgacatgatatgtaaatgcttgtattgcttgcctgagaatgttatgtgataatatttgtcttccctggctcgacatagttgataagcataatgaaaagtaaatcttggaaattcgtatttatttgagatgttgtttacctgctatctggttttacgagtttataattcctttataaaaatccatgatttcctcacattttcactatattattattggaccactagtaaatgtcaaagtcgaactatcgtctctacttcttcgagattagaagatactcattgagtacacgttgtttttgtagacatactacacttgctgtgcatttttgtttcacaggcgcatgcaactctagtggcctagtaggcatagcgacatagttgatacggagacttaggtgagctgcacttcccgagatgacccacaaccagcagtgtctctttcaaattaccgtatttactttctgtccaatactatatttcgtacggttattgtactacattatttactataaattgctcatgtacttgtgacaccgggttctgggatgatcacgggatttttcagtagttaaattttgtaaagacatcctcatttatctagtagagtttattatttattcgtttaaagaaaatgatttcaaaataattaaaatgagaaatttctagtaaattgtggttggcttgcttggcagtggtgtccggttccatcacgacccttagtagattttggatcgtgacaacatggtatcagagaactcgattcccttaggtctcacgagtcatgatcaagtctagtagagtctcgcggatcagtatggagacgtctgcacttatcttcgggagactacaatgctgttaggagtacttcgcttcttgattcctcatcgtgcgatttgattcattgaggcttgtgccttgtttccttcctactcaatcttacgtgatgcgaaccgcttgttataaatcgagaatcgaagaattttaatggtacaacggatgtggtgcgagatgtttctccctgaatagttgattaggctattgtcgttgccttgtggaagggtatctcatcattttggcttagtaacagtattcctgagagctttgaggctattcacagattgctatgatgctcacgattggttatcgcatagtattgaattgatggtaggatatttgcctatatgttggggcggtgaatgatttgaaaggaagcctactcagtgcatgattcagagataagatatctcatttccggcggaggaaaagcaattggcctatgaatgtccaaatttggggtgatggagtaacgagacttggtaatttcgagcgtgttagaatttttatctacgatgtagtgttgtcgtcctcgattgtatatgttaagttttccggtgttatggtcttctgcaattcgcccttggggaaggatattgtgaaataatattggagaaacgactattagatatcgcggggtgcggtggctcaggattgaatcagtgtttctaatgctgacggctcgagaaagatgatctccggaaaggtttaaagttagtagcgatttgtgggttcaagttctacgaagatagattttgttgaggcaacatctgagcagcaaaggatgaggaaggacatgtggggagtgttaggcggtggttaaaatttctaaaacgccaggtataagaagcaaaggtcgagttgtcgattaaaggggtgagatccgccaaagtgggagagtggcagagttgcataggggcttggtggtaggatgaccgcacaccttaagaagagtgtggaatgatttgggaattttagagattgaagattagggactacgaatttaattgggagtgtgggatattatgcagcaagagatttgatataacggaagggatctgcttgaaatgaagaaggatacaacataactttgaattggaaggatgctgccgcatatttaattaatgtctaggaggggtgaatagacttgtgcaactagagagtgatctcggaattaggatgggttatttatgtcgtagtgattgtaccccgtgcagtagcattggaagatgtcgggaagtgatttccatgggtgtgttattcactgtgagtaggttagcggtcacgtggttggcaaagcttctacgaaggattttactggccattcgggtaagaggtcgaatatgtgcatgttgatggaaattcagggtgttcatgaagtgctaatggaaggatttcaaggaatctagcagtttaattgcgcgaggtcatgtcactaagagataaagaatcttggtgaattccagaggtgtgtaatagtggcttcaagctaagtgagagtgtcccactatctacggttggattgcatggtcttctatttgtaaggtttaggattaccagcatattggtgagttatttcagctaagggaaagagcataagtagtaatttgagtgaaggaattgttaaaggtgtgctatagttggccttattggctcatgctcgggctttgggagtatttgggatttatgcttcatacagagctgatttaaaagcgaagtgattaagtcaggtgcttcgtggagatgggtgttcatgtgaataacggtcttaggggattcaaaggttaaagtgtggtgcctaaggatttctagtccataagtatggttaagaatcaagcttttgtaaaagattatgataagaggcttggaatgttctatgatattttcaacttgcagtgtggcattgggaggaaatgagaaaaagacttcggattcgtagaggaattatcaaaacggttgtatcagttgaagatgcgaatgtgcatgcaaggagggtgtgaaacggttcatgggtttggagataatatggtctcgtggaatggggttactcaagatgagtgcagatttaggttggtgatgtaaggaatgaagctattattatctctaaggcaaattaaggaataattagaagaagttagattgattagccatggttgaattggcataatggtgtcggagatcagttccttcagcgtgattaagttatgcatgtgatttgtggcggtacatgcgaggtttgacggccaccgtaattgattttatttggaagtattcaagtattatggccttgttatgtgtaggcggatcccggaaggttcatgtagaccactacttgaggatttgaatgttctacggttatgagaattcactcgcgtgtagctatggttctcttggaatgagttaggtaaaaagtttctatgtgatgaagtttttaccctaatagtggttcaggagttatgatgaaattcttgtattatcgcatattggcttgttaggtgcagtgagcggtatgaaatttgaaagtgaggataaagtttgcggttctgtatttgacaaggatgtcacgagctcggatgagcaagaagggggtttggatatttggagtaagctgttattgtcttcagcattacctaagatcggtattttgtgtcggaggcttacattttggttacggattcttgatatgctttacaatattagtgtgaccgatggtatagatgtgcaaactctttatctaatgcgaacggtcgtgggagcgtatctcatgggaagattgtataagtgtgacatgtagtcacttgattgattaaatatttaaaccaagtacgaaaatcgtggtaatatcactaatttgagaatttatgcctagaggacactcgacttattgggttatggattgtggaggattgccccggttatgatggtagttcgcatgtgttatgagaaaaagggagttattatgaaccttcgaaatgttattagactagttcagtttgatcagaatcaacttgaggtctgtggatggatttaaatgtgaatatgggctatatatcaggccaaatgtgttcatttcagcaatgcactcctttggacaagtagtcggggtactattttgtcgtcagctatttcatgaaatgatatatggctctgtatgagttgtaagacggcttggtgaatttcttatgtgttgaggttccgcgtagagatgatgttataggagcaggatgtctctcgagatttagatcgtatatggcacctcaattgtgcttgagttttatagcctatggcactatatgtctccccaaggatggtattatgcaattagtgtgcttgtgatcgatattcggtattttgttgtaatgagcaatttagctcgatgtatatctccttatgtgaattctatgtgttgatcgggtgtggtgctgccataggtatgttatttggatcgggttgcatgccgcaatagtgtgatgttgagtacatttttctatatgctatttttgtatgccttgtttcccattttcttaaggaaagtccatattagtacgtgagttgagtagttccttccagatttcgttttccttttgtcatgttcgagttcatagcctattgacatattgtggcattatatgagacttttgatcatgtccggagtggcttattgcctgagtagttcgtactgggtgagacaagatcattggatttaggatcagtgaaatctgattatatgaagtatattaaggagctaagatcattatttggttcagaatgaggtgatggttcttgtcaggagtatagacctaatgatttgttgattcggcagttggttatgaatttatacacatctcttccgtcgtggcggtattgtaagagttagagaaagacctatgtatgtcatgaggtgcaatgggagcatcaggttcgtggaatttcgattattatgcttagagaatgttattgtggttctgtgaataaagcagtgcaaggtgtgaatccagcaaaggtatgtagtcatattctggtacatcgtgcgtgatttatacggttagcgtatgctggaaataagcttggcagagaattctggatgttggaattgggctctaaggcttatttgtctaagtgaaaaagggtatcttcggattgatcgagctagggtgcctagctgagttgtggtagcacgagtaggtgcttgaggtgttacgcagtgattttgggcaaccccaatgtagttcttagcatgtttgaggacgaacgtatgtttaagtatgaaagaatgtaacgacccgaccggtcattttaagctctagtgcgtcgttcagcagtttgaggccataagtagcttcacttcaggtattgtgacttgtgcgcacggtcagaattgatttctggaaagttcggagttaatttggaaagataattctcatttccaaagctttatgttgaaagacttagccaagattggatttttgagtaaacgacctctgcattggtatttgaaggttccagcaggttcgtatgatgatttcggactccggcgtatgtccggatcgagttttggatgacccaagagcgatttggcgactattgtggaagttagcattttggaagaatttcataagtttgggttgaagtgcatttcgatgtaatagatgaccatttgggattcttagtctgggagtagctccgtatggtgattctggagttgggagcgcgatcggaagtgaattcaaaggtccgtgggtcattttggagtcatttggctaaagatagaaatttgaaggttcttgagaagtttgaccggaagtggactttttcgtatcgcggtcggaatccattttcgaaagcttgagtaggtccgtaatgtcgaatatgacttgtgcgcaaaatttgaagtcaatcggacgtgatttggtaggtttaaacatcgaaagtagaagtttgaaattctaaagttcataaagcttggattggaggtcgattcatatttttagcatggtttgatatgatttgatgcctcgagcaatccataatgtgttttgggactggtcggtatgattggttggggtcccgggggcctcaggtggattctcggtggttaatggagagaaaatggaatttggagaagtgctgaagcatctgcttctatcataacagcacctgcggttggtcgaccacaggtgcgagacagcagaagcggtcgtagcctcgcagatgtggcccagagctggccaggccaaaccatagaagctgctccttaggtgcagaagtggcttcgcagatgcatcttcaagaccgcagaagcggtcccaacccttttagccaattccgtagatgcggcctcccttcacagttgcggtcccctaaccgcagatgcgaaaaccgcagaagtagtcagcttcatttaagtcgaaccccagccatttttgaccatttggcactcgggtattgagcgattttggagctcttgagaaagtatttcacatagcattgtgaggtaagttcatcccccttatctctaagtttaacactcgagttttgctagattaacacctaaagatttggagaaatcaaggggttagagctagacctagggttttaataaaacatagattttaccacaaaatttgttatgaaatggattagaaatcatatattattgatccttgggttatagagaacaacttccttggaaaaatttcggaatccgggcatgtgggcccggggatgaactttaggaaccttgcatttagggttgggaaattggtttaataattacactatgaacatttgagcatgtattgactagttcttaccctatttgaatagttttggatcactcggctccaaattcgaggtttgtgcgcgttcttgagtcggaatataggcttcggagcgaggtgagtctcctttctaaccttgtaagagggaattgtccccataggtgatataattggttatgtactcctatttgtgggggctacgtatgcacgaggtgacgagagtccatgcgtagctactattatgtttaagtccgtgtagtctaggacccaaaagcatgctatacttggactatttgtaatcttaatgacagctgaattgcttaaatcacatcgaattagtaaatgaatttctaaaagaatttaatcttcattttcttaaattgttaaaagagaattggcttttctttggataattgttccatgttgacttcttgattgactgtttgtgtgtgtttacctttggaacaggccgaacgcctcggtagattaaaaagatgcatctattgttcgtgtcgttcgaccctcggcagtgcacagtttaaatattggttgattgcgccgtacgacctcggcatgatatgcgcatgcttgtatgacttgcctgagaatgttatgtgataatatttgccttccttggccagacatagttgataagcataatgaaaagtaaaccttggaaatccgtatttatttgagatgttgtttacctgctatctggttttacgagtttataattgctttataaaaatccatgatttcctcacattttcactatattattattggaccactaggaaatgtcaaagtcgacctctcgtctctacttcttcgagattagacgggatactcattaggtacacgttgttttcgtactcatactacacttgctgtgcatttttgttgcacacgcacatgcatctctagtggcctagtgggcgtagcggcacgattgatacggatacctagctgagttgcacttcctgagacgacccgcagccagtaatgtctctttcaaattactgtatttactttttgtccaatattgtattttggacggttgttgtactacattatttcctagaaattgctcatgtacttgtgacatcgggttcagggatgatcacgggatttttcagtagttaaattttgtaaagacatcctcatttatccaacgaagtttattatttattatttatttgtttaaaggaaatgatttcaaaataattaaaatgagaaattgctagtaaattgtggttggcttgccagacagtggtgtccagcgccatcatgacccttagtggattttgggtcgtgacaaaaatggaggaaaatggccaagacccgcgatttttaaagaaccttactgcttccagcaattccgcaccttcggtcatacgactgcttctgcagtttcacaggtgcggaccctctaccactcctgcggtttctctctgggctcccctttgcacttctacgcctcgattcccgtagttgcggtcacgcctctatggcgagatgaccgcatatgcggtccttatacttccatccaaaaatcgcatatacgactctcctagccacttatgcggctctgcacctgcggcccaagcctcgcaggtgcggttacaccagaagacagctgctacacttcctcttccaatttgaaaaattgatctgttaatcattcggaatccacccgaggcccccggaaccccaaccaatcataccaaccagtcctaaaatacattatggactttctcgaggcctcaaatcataccaaacaacgctaaaatcatgaatcgacccccaatccaagctaaaggaactttagaatttcaaacttctacattcgatgacgaaacttatcaaatcatgtccgattgacctcaaattttgaacacaagtcatatttggcattacggacctactccaacttccgaaattggattctgaccccgatatcaaaaagtccacttctggtcaaacttctcaaaaaccttcaaatttctatatttagccaaatgacaccaaaatgacctacggacctccgaattcacttccgatcgcgcccccaataccagaatcaccatacgaagctattcccgaactcagaatctcaaacggacattgataaccctgaaattcacttcaatctaaacttatgagattcttccaaaaatgctaacttccacaataggcgccgaaacgttcccgggtcttgcaaaacccagtccggacatacgcccaagtccgaaatcatcatatgaatcagctggaaccttcgaatcccgattccgaggtcgtttactgaaaaatcctaccttagtcaattctttcaacttaaagctttcgaaatgagaattctctttctaaatcaactctgaacttcccgcaattcaattccaaccgtgcgcacaagtcatagtacctgaagtgaagctgctcatggcctcaaactgctgaacgacgcgctagagctcaaaacaaccggtcaggtcgttacattctctcccacttaaacatacgttcgtcctcgaacatgctaagaactacgctggggttgcccaaaatcactgtttaacacctcgagcacctaccagttctaccacaactcagctgggcaacctagctcgatcaatcttaagataccctttatcacttaggcaaataagccttagagcccaattccaacatctgaaattcactaccaggcctgttccaacatacgcttaccgaatcaataactacacgcagcaccaaaacatgactgcataccttagctgaattcacaccttgcaccattttactcacaggaccacaataacattctctgatcaaattatttgaaattccacgaatttgatgctcctattgcacctcatgacattcaaaggtcttgctctaactcttacaatacttccgcgatggaagagatgtgtagaaattcataaccaattgctaaatctacaaatcattgggtctatactcctaacaagaaccatcatctcattctgaaccaaataatggtcttagctccttaatatacttcatataattagattgcactaatcctaaatccaatgatctcgtctcacccagtacgaaatgctctggaaataagccaccccgtcgtgaccaaaagtctcatataatgccacaatgtgacaatgggctaccagctcgaacgcgatacaaaaggaaagtgaactctgaaaaggaaatccaattaccccgctcgcaactaatacatgcgacgtggtcaacataattaaacaaacaccccgctcgcgaatcatacatgcgacacaggcacacaactaataagagttttcctcagaaagataggaatcaaaacacataaaaacagatatagaaatttgtactcaatatcacactgttgcggcgtgcaacccgatccaaacaacatacccatggtggcgtgccacccaatccacccataaaattcacataaggagatacataccaagccagattgctcattacaacaaaatactgaatgtcggtcacaagcacgctaagtgcattataccatccataaggagacatatagcgctataagctaaaaactcaagcacaactgaggtgtgatatacgatctaaatctcaagagccattctgctcatataacattatctctacgcggaacctcaacacataagaaattcaccaagctgtctcacaacttcacacgtcacaatatatcattacatgaaatagctgacgacaaaataatacccagactactcatccataaggagcgcattgatgaaatgaatacatctggcctgatataaaacccatattcacatttaaatgcatccacaaacctcaagttgattctgatcacgctgaactaagctaataacctttcaaaggtccataataactacccttatctcatatcacacaagaacaaccatcataaccggagtaatcctccacagtccacaacccaataaaccgagtgcccttcaggaattagttctcaaattaacgacatcaccacaatctttatactttgtttaactcttcaatcaatcaagtgactatatgccacacttatacaaccttcccgtggggcacgctcccacaaccttctgtaacagataacaggcttgtgcattcaaaccaatggttgcactaacgctaaagagcgatcaataatccttaaccaggatgcaaagcatctttcacaaaacaccgatctccagtgacgctgaggacattactagcttactttgaacatcccaactcctttcctgctcatccgagctcgtgacatccttgtcaacaccgaactacaaccttgatcctcacttcaaattccataccactcactacacccaacatgccaatatacgatagaacacgatttttcatcataacttcagaaccactaataaattaacactacatcatataaaaactttttacttaactcatttcaggagaaccatcacaacacgcaggtgaattctcataaccgtagaatatgcaaatctccaagtagtggtctaaaccaccctaacccctccgggatcctcctatacataacaatgctataacactcgaatacttccaaataaaatcaattacggcggccgtcaagccttacacgtaccgccacaaatcacatgcataacttaatcacgctgaagaaacagatcaccaccaccattatgctaattcaaccatagccaacaaatctaacttcttctaattcatccttaacttgattagagataataatagctctattccttacattaccaatccaaatctacactcatcttgagtaactccattctacgaggccacattgtctccaaacccatgaaccatctcataacttccttgtgcacatattcacatcctcaactggtatgcccattctgataatccctctacgaatccgaagtcttttctcattttcctcccaaatgtcacactacaagtgaaaacatcatagaacgttctgggcctcttctcataagtttctacaaaagcttgcttcttaaccgtacctataggctcgcaatcattaggcaccacactttacccttttgaatccactaggaccgttgttgagagccacccgctctaacttggccccgaatataatcaactccctgaatcttctagcacatcaataccctctcgacgaagcacccggcagaatcacttcctttaaagcctgcatctataaaaggcataaatccagaatccttccccgcgtctgaacgtgagccaataagtccaaccatagaacacctttaacaattcatttgctcaaatctcctcttatgttactctctcttagctaaaataacccactaatatgctaataaccagaaatctcacatatggacgactatgaaatccaaccataggcgttgggactctcccacatagcttgaatccactatcacacaactctggaattctctaggattcattatctcttattgacataaccttgcgcaatcaaccgccaaaattcaaggaatctttctataaaacccctttttatactctgaatcatcaaccacattcgcacgaccaaattttttgttgtataaccaatagaattctttgcaaaatcttcaccaaccatgcgatcgccaatctgctcactatagataccgcacctatggaatttacgtgccgacatcttccaatgctgctacacgagatacaatcactacgacatccataacccatcctgagtctgagctcactctctagctacacacccttcgtggtcatcaattaaatgtgcggcaacattcatcaaattcaaagttatgttgtatccttcttcattttgagcagctcctttccgttatattaaatctcctgtcgcataatagcccatacttcaatttaaatccgtagaccccgatcaccaatcagtaaaattcccaaatcattccaaactctccttaaggtgcgtagtcatcctaccacaaagcccacaagcaactccgccactctcccactttggcggaactcacacctttaatcgactactcgacctttgcttcttataactggccttctagaaattttaaccaccacctgacacacttcccacatgtcctttctcatccttcgctgctcagttgttgccttaaataatgtctatcttcgcagcacttgaaccctcaaatcgctactaaccttaaactttttcgaagaaaatctttctcgagccatcaacattagaaacacagattcgatctgaaccactgcaccccgcgatatctaacagttgtttctcccatatcatttcataatatcttaccccaaaggtgaatcgtagaagaccataacactggcgaactaaacacatacaatcaaggacgacgacactacatcgcaggtgaaaattccaccacgctcgaaaataccaagtctcgttactccattactccaaatctggacatttataggccaattgcttttcccttgcttggcataaaataccgaacctctagatcatgcactgagtaaacctctcttcaattcatttactgccatgacaagtagacaaacattctaccatcatatcaatactacggaacaattgttaataagtatcatggaaacttgtgcctagcctcagagctctcagaagcactgccactgggctgaaataatagaatatccttccacaaggggatgatattagctcaaacaaccctgcagggagaaacaccctgcgccacactcgtagcactattacaatccttaaattctcgatttgaccagcggtttgcgtcgcgtaacattgagtatgaaggaaacaagagcataagcctcaaagaatcaaatcgcatgatgagtaatcaagaagggaagttctcctaacagccctgtagtctcccgaagatatgtacagacgtctccgtaccaatccgcgagactctactagacttgctcatgacttgtgagacctaagagaacttagtgctctgataccatgttgtcacgacccaaaatccattaagagtcatgatggcaccggacaccgctgtcaggaaagccaactaaaatacttaattaaattctcgtttaaatattttccgaaaatacttctttaacacgtgtaaaacaatacatcgtaaattcctttaaataaataataaaatgtttaacaactcttaaaatttcctgaataaacccaaagacatcccagaacccggtgtcacaagtacatgagcaatttttaagaaataatttactacaacaaccgttcggaatacaatattggacagaaaataaatacagaaaactaaaagagactctgctggctgcgggtcgcctcgagaagtgcagcttacctaagtctccatgtcaaccatcctgtcatgctcagtaggccactagagacgcatgtgcctatgcaacaaaaatgcacagaagtataatatgagtatgaaaacaacgtgtacccaatgagtatcccgtctaatctcgaagaattagagatgagatggttgacttcgacacttactaattgtccaaataatgatatataattaatgcaaataatcatggatttattaagaatgatagaaatttaaagtatgtcacgaacaggtgaaagttcctttttatattaaaagtctccggattcaaaatccattagtttttaaatatctcaagtcggggagagcaaatatcaatatcaataagtctcaaggaaaacactacaagcatgcgcaaatcttgccaaggtcgtatgacccgatccaacagaaatgtaaaatgtgcactgccgagggtcgaatggcgtgaaccatagacgcatctattaccccgctcgcgcatcatacctgcgatgcggtcaacataaataaacaaataccctgctcgtgattcctacatgcgatgcatgtacacatagaaatacatgctcaagcagtcaattaagaatatataacatttatccaaataaaagtcagttctcttttaacaatttaagaaaatgaagtttattccttttagaaattcacttactaattcgatgtgatttaagcaattcataccgtcaataggattacaaatttttccaggtaaatcatgcttttgggtcctagactacccggacaatagcatgatagtaggtaaacacagactctcgtcacctcatgcgtacgtagcccccacaaataggagcacgtaaccaattatttcacctatggggacaattccttcttacaaggttagaaaggagactcaccttgctccgaagatccataacctgcattctacgctcttctgaagactcgaattgatgcacaatgctccaaaactagccaataattatgcatatccattaaaatatgttcaattactcattacaatccaattcataacaattcctaaccccgatcgaaaagttgacaaatgaccacgtgcccggattcctaaatggttcgaagataaactttacccatatccccacgaactcaaatatataatttactctcaatttcatacccaaaatcgtggtcaaattccatgaatatcaattttctagattttccctcaaaccccgaaatttctaccaatttacatgctaaaatccatacataattaaaatatatttaagtcaagaaaggtggggttatcttaccttaacgttgatgaagaaaatcccctcttgaaactctccaaaaatcgcccaagccaagaaaatatgaggaaaatggccaaaaccccgattttaaaacatcctctacctccagcactttccgcacatgcggtctcttgacttctttagcggttccgcaggtgcggttcaaataccgcttctgcggttcctcactaagctgccctttttcgcttttgcatcttctccaccgctggtgcggtcccgcatctgcggtcctagctctcatcagccaatgcatttgcggctcttctggatgcttttgcggctttgcacctgcggcccatttctcgcaggtgtggttatgacagcaacctcagccttccaaaaattccgtctttaatccgttaaccacccataatccacctgaggccctcgggaccccaaccaatcatactaactagtcccaaaacacgtgacggactcgctcgaggcctcaaatcatatcaaatagtgctaaaaccatgaatcgacctccaatccaagctttatgaactttagaacttcaaacttctactctcgatgtttaaacctataaaatcacgtccgattgaccccaaattttgcacacaagtcacatttggcattgcggacctactccaactctggaatcggattccgaccccgatattaaaaagtctacttccggtcaaacttctcaaaaaccttcaaatttctatctttagccaaatgactttaaaatgacctacatacctccaaattcaattccgatcgcgctcccaactccagaatcaccatacggagctactcccagactcagaatcccaagcggacaccgataacactgaaattcacttcaagacaaacttatgaaatttctttcaaattgttaacttccaaaatatgcgtcaaaacgctcccgggtcatccaaaccccgatccgggcatacgcccaagtatgaaatcatcatacaaacttgctggaacctttagatcccgattctaaggttgtttactcttaaatccaatcttagttaattcttccaacttaaagcttccgaaatgagaattctctttccaaatcaactccggacttcctggaattcaattccgactacgtgaaaaaatcataatacctgaagtgaagctgctcatggcctcaaactactgaatggcgtactataactcaaaacgatcggtcgggtcgttacaattcatccggccgccgcgaagatgtattaggatttgcggtagcattattggtggagaaggatgaagaaggatattgttgcatatgtatctaggtgtttgaattgttagcaggttaagtatgagcatcagaggcctggtggtttgtttaagaggattgagcttcccaagtagaagtgggagtggatcattatggatttcattgttggactcccatagactcggagcaagttcgatatagtctaagttattattgaatggctaaccaagtcatcgcatttcattcctgtggtagtctcctatttttccaagaggttagctgagatctatatccgagagattgttcgtcttcatggtgtgcccgtgtctatcatttcggatcgaggtacgcagtttacctcacatttctggagggcagtttagcgagagttaggcatacaggttgagttgaccatagcatttcatccttagacggatgggcagtccgagcgtgctattcagattttggaggatatgctccaagcttgtgtcattgactttggaggctcgtgggatcagtttttgcctttagcagagtttgcctacaacaacaactaccagtcaagtatctagatggctccttgtgaggctttgtatggtaggtggtgtcggtcaccggttggatggtttgagtcgggagaggctcggttgttgggtacggatctagtacaggatgccttggacaaggtcaggatcattcaggataggattcgtacagctcagtccaggcaaaagtgttatgccgaccgtaaggttcgtgatttggcattcatggtctgtgagcaggtattgcttcgggtgtcgcctatgaagggcgtgatgagatttgggaagaggggcaagcttagcctaggtttattggcccgtttgagattcttgatggagtgggggaggtggcttacagacttgcattgccgccgaacttatcagccgtgcatccagtgtttcatgtgtccatgctttggaagtatcacggcaatccatcccatttgttagacttcagcactgtccagttggacaaggacttgtcctatgaggaggagctggtaactattctagaccggcaggttcatcagttgagattgaagagtttcccttctgttcttgttcagtggagaggtcatccagatgaggcatcgacctgggagtccgagtcctatatatggatctattatccccatcttatccccgactcaggtactttcttcatatattcgttcgaggacaaacgattgttttagagggggagaatgtgataacccaaaaagtcatcacctgttttagaaataaactctgtgtctcgaggccttaaaaaccactttctatctcacctcgacttacgtgcgtggtctggatctatatccggaagccttctttgtgaaaatatgagaaatagaaatttctagagttaaaatttgattatggttgactttggtaaacattttgagcaaacggacccggatgcatgttccgacgatcctgggaggtccgtagtaaaatatgggacttgggtgtatgcccgaaaatgaattccgaggtcccacaccttagaaattaatttttgaaagaaactatttactgaattatctaagaaatgaagaaaagaattaatatttgaaaccattggtattgggcccgtattttggttttggagcccggtacaaacttgatatagtatttaaaagataactgtgatatttggtgaaaaacggagtttatttgacgtgagttggacttccggttgaagagttatgaactttgagtgtttttgatgaaaaaagttgagttttgaggtttaattcatggtttgcatgttattttgatgatgtgatcgcacgagtaggtccatatgatgtttttgagttagtatgcatgtttggtttgaagtcccgaggtctcgggtgagttttgggtaggttccaagatgttttaggcttaaaacatagctgttgcaggtttagagaagttgcagatctcagaacccgccagtgtggtccgcaatgtttttgttctgccgcggaagggcctttgcggccacaaaggattttgtgctgaccgcggtggcgggctttgcagccgcactcgattttgtgcggtccgcggtgaggaagaatctgcaggttatctggtctgatttcggaagcccatatcttttgatctacaaggaattttgagatgattcataaacgaaagttgtatcccttcgtgtccagtttccaaggtatatttaaacgggattttcagttatttttcatttttcaaaactccaaaaacataagaggcaatttttcaaacaacctttcttctccaaaatattagtaagtgatttctaactcattttctttactccttgacgtctttttacaagatctcatcctagaatcaatggtttttatgggcgaaattgggtgttttgggtagaacctaggtttttcaaattttggggatttggacctcgatttgaggtctgatttcaaaccaaattatatatttgggttcgcgggggaatagataatcgggttttggtttgaacctcgggttttaaccatgtgggcatgggggcgatttttgactttctggagaaaactttagaaaacttatttccatgcattagaatttactcaattagtatttattgatgtaataaagtaacttgtggctagatacgagcgaattggtggtggaatcaagaggtaaagtgatagttgagacttgaagtgtgttcgtggcatcgaggtaaatatttggtctaaccttagcttgagggattaggagtcgagtcctatgtgctatgtgatatttgttgagtacgacgtataggcatggcgacaagtgtctatgcattggtgtcaagcatgcccctgggtcttgtattatgattattatgactccgtttctattattcatgccttttatgatgatttctattgttgagtagagtttgtggaggaaatagtggtatttgagtatgaagagcgttggctcaagtggtacaatgaatttgtggaagtataattggcatttgaactttatagatcattggctcaagtcgtgaagtgagttgtgaattaaaattcaaaaaaaaaagagaattattatattgtctcccttgccgggatattgttgcttttaatgctatctccctttccggaatgttgatgcttttgaaactgttcccttgtcgggatttgattgttgaactattattcccttgtcaggatttcatttcaatcttacttatttcattgccttattgtttgtgattgttgtttgggtgaggaagagtgtttaagcacgaagggtgataccatgtataattttgtaaggaagagtgtaaatcacgaagggtgatgctgtgccacacgatgtacaattccgtgccaattatattgattatatggtgaggacgagagtaaaagcacgaagggtgatgccgtgaaatttatattgattcttttgatgaggacgagagtaaaagcacgaagggtgataacgtgcacttgtttgatccctgattcttgctgataattgagatagggtgttccttgtatttaactgctgtctttctattcttaattaatgtttccccgtagcatgttaccccctcccatacttaactgtacattgctgttcttcttttccgctgtatatgatttaactacacgggtttatttggtagtctggtcttagcctcgtcactacttcgccgaggttaggctaggcacttactagcacatggggtcagttgtgatgatactacactctgcactgtgtgcagattccggagcagcaacattcagaccttatcttgggtggttgccttcagtccagttagagatttcgaggtagtcctgcaggcgtctccctttatcccttcatcctgtttcatatacttatttcagaaacagtgtattagctatctttcaaaccttgtttgtaaattctagactgtctataaagcctgacaccaattctgggtagattttgcttaagatgttgtatcgtatatttaatcaaatgttttatcgttttcttccgctcgctttaaatttccattgtttataactgtcgattcacacttgttaaagaaattaaaaatgggaaaatggtaattggtgtaagtggtccgcttgcctagcttttactagtacgcgccatcacgacccccgagggtgaaaaatccgggtcgcgacaaaatttgttatcatcttttattttttgtttttagatctttctaacattttttttcaatatttattttattttatcttattttctgatgtcattatttctttttttacaaaaaaaaataatttatttcactaaaaaaggatgagttttaataaaaattgtctacataaactttaataaatatttttagtctttggttgaaattatttcatatttttctgttggctttatctgatcagcctaaataggtgttatcggtatatcatctatttatattagctataaaaagtaaacaataaatatggtcggaaatcatgtaaatattccataagatttcatttttttgagtttatccatgatataacttctattataataattttaaaactctctactaatgttcaaaaatatcttatctttttattatctttgaaataaaaaaaataaagagttttttcgaaataatttgtttacatttaaaaaaaatcacgttatatcaatttttgttttatatatactctttgttacacttaaaaacctctataaaaactatcaattagaaaccaatttctctcttgttgagtttgaaaaaaaaaacctttcacataatctaatgattcaaaactaatattcttcaacgaaaaaatattatacccttacaatattggcctgactatagctaaatgaaggggtttcatcttatacccttcaattccttgaatgtgctaaattgaaattaatgatagcaaatgtatagacaaaattttgttatttatgtctatttatgcaaattgactcttcaaataaatattcttcaagaaatttttttttaatattgattgattttgtgatgtttctttctccagtatgtatgtttactttataatatatgtaagtgtcacgacccaaattccattacgagtcgtgatggcaccagatactgctgtcaggcaagccaaccaatacttaattaaattctcgttttaataattttgaaaactatgattttccttcaattttaccactaaaagataatcgtttcaaatcaagtatgaatgttaagaagttaatacaagatacccataatcatcctagaacccggtgtcacaagagcatgagcatttactagggaatggaataaaatacagtaactgtccggaatacaaagtgggcagaaatgaaaaacacagaaaaatactctgaaggggactctgccgggtcgtctcgataaatgcagctcacctaagtctctgtatcaaccatgccgctatgccactaagccactagccacatatgaacctgtgcaacaacaatgcatagcaagtgtagtatgagtacgaatacaacatatacccaatgagtatcccgtctaatctcgaagaagtagagacgagaggtcaacttcgacacttactaatggtccaatgataatatagcaaaagtgtgaggaactcatggatttcataaagcaaaatttaattcataaggccggaaagtaggtaaagaacttctcaattaataaaaggtttcgaaggatttacttttcattatctttattaatttatgtctgccaaggaagggcaattatcaacatttaaaattctctggcaagcaatacaagcatgcgcatatcatgccaaggtcatattgcccgatccaacataaatgtaaaatgtgcaatgcggagggtcgaacggcatgaaccctagatgaatctattatcccgctcgtgagtcatacatgcgatgcggtcaaatttaaataaacaatcaccttgctcgcgaatcatacatgtgatgcacgtacacatagacttacatgctcaaacaaccaattaagaatttatcggggaaagtttatccaaataaaaccaattctcttttagcgatttaagaaaatgaagtttaatctttttttaaaaaattcatttaccgatttgataggatttaagcaattcaactgccaacaaaattacagatattcctagtatagcatgcttttgggttctagactacccagacttatatataatagtagcaacgcacagactctcgtcacctcgtgcgtgcgtagccccccacaaatagaagcacataaccaattattacacccatggggacaattctctcttaaaaagttagaaaggagactcacttcgctccaaagatccacaaccggcattccacgcccttccggagactcgaatcgatgctaaatgctccaaactaaccaacaattatgcaaatccattagtatatgctcaattactcattccaatcaaatttataaaaattcccaatcccgatcgaaaagttgacaaaatttccatcgggcccacatgcccggattttaaaatttctcaaagataaagtttacccatgaactcacgaactgaaatatatgattttctcctaatatcatacccaaaatagtggtcaaaatccaagaatatcaattttctaggttttcccttaaccccaagtttctaccaattttcttgctcaaatccctaacaaaaccatgtatttaactcacaaggggtgaaattctcatgtttgatgataaaatccctctctcgaagatctccaaaaatcgcccaaacaagagtaaaattataacgacccgaccagtcgttttgagctctaatgcgttgttcagcagtttgaggccatgagcagcttcacttcaggtattatgacttgtgcgcacggtcgaaattgatttttgggaagttcggagttgatttggaatgtgaattctcatttcagatgttttaagttgaaacaattagctaatattggatttttgagtaaatgaccccgaaattgggattcaaaggtttcagcaggttcctatgatgattcggacttcagcgtatgcccggatcgggttttgtatgacccgggagcgatttggcgcctattgtggaagttagcattttggaagaatttcataagtttgggttgaagtgcatttcggtgtaatcgatgtccgtttgggatttcgagtatgagagtagctccatatgatgattctggagttgggagcgcgatcggaagtgaattcggaggtccgcgggtcatttttgagacatttggctaaagatagaaattttaaggttcttgagaagtttgaccgaaagtggacctttttgatatcggtgtcgaaattcgattccgaaagttggagtaggtttgtaatgtcgaatatgacttgtgtacaaaatttgaagtcaatcggatgtgatttgataggtttaaatattgaaagtatatgtttgaaattctaaagttcataaagcttggattggtggtcgattcgtggttttagcatggtttgatatgatttgaggcctcgagcaagtccataatgtgttttggactggttggtatgattggttggggtcttgggggcctcaagtggattccgtgtggttaacggaacgaaaatggaatttggagaagtgttgaagcatctgcttctttcataaccgcgcctatggttggtcaaccgtaggtgagagaccgcagaagcagtcgtagcctcgtagatgttgcccagagctggccaggccaaaccgcagaagcggctccttagcagcagaagtggcttcatgaccgcagaagtggtcccagcccttttagccaattccgcaaatgcggtcccctaaccgcagatgcggaaactgctgaagcagtcaacttcatttaagtcgagccaaccaattttgaccatttggcactcgggtattgagagattttggagcttttgagaagggatttccacatagcattgtgaggtaagttcatcccccttatctctaagtttgacactcgagtttttggtagattaactcctaaagatttggagaaatcaaggggttagagctagacatagggttttaataaaacttagattttaccacgaaattggttataaaatagattagaaatcatatattattgatccttaggaaccttgcgattagggttgggaaattggtttaaaaattataatatgaatttttgagcatttattggctagttattaccttatttgaatagttttggattgttcggctccaaattggaggtttgagcgcgttctttagtcggaatataggcttcagagcgaggtgagtcttctttctaaccttgtaagagggaattgtccccataggtgatataattggttatgtgctcctatttgtgggggctacgtacgcacgagatgacgagagtccatgcgtagctactattatgtttaagtccaggtagtctaggacccaaaaacatgttatacttggagtatttgtaatcttattgacaactgaattgcttaaatcacatcgaattagtaaacaaatttctaaaaggatttaaacttcattttcttaaattgttaaaagagaattgtcttttctttggataattgttccatgttgatttcttgattgactgtctgtgtgtgtttatctttggaactgatcgaacgcctcggtagattaaatagatgcatatatggttcgtgttgttcgaccctcggcagtgcaccatttaaatattgttggatcgggttgtacgacctcgacatgatatgcacatgcttgtattgcttgcctgagaatgttatgtgataatatttgtcttccctggctcgacatagttgataagcataatgaaaagtaaatcttggaaatccgtatttatttgagaagttgtttacctgctatctggttttacgagtttataattcctttataaaaatccatgatttcctcacattttcactatattattattggaccactagtaaatgtcaaagtcgacctatcgtctctacttcttcgagattagacgggatactcattgagtacacgttgtttttgtagacatactacacttgctgtgcatttttgtagcacaggcacatgcaactctagtggcctagtaggcatagcgacatagttgatacggagactaaggtgagctgcacttcccgagatgacccacaaccagcagtgtctttttcaaattaccgtatttactttctgtccaatactatatttcgtacggttattgtactacattatttactataaattgctcatgtacttgtgacaccgggttctgggatgatcacgggatttttcagtagttaaattttgtaaagacatcctcatttatctagtagagtttattatttattatttatttgtttaaaggaaatgatttcaaaataattaaaatgagaaatttctagtaaattgtggttgtcttgcttgggagtggtgtccggttccatcacgacccttagtggattttggatcgtgacaacatggtatcagagaactcgattcccttaggtctcacgagtcatgatcaagtctagtagagtctcgcgaatcagtacggagacgtctgtacttatcttcgggagactacaacgctgttaggagtacttctcttcttgattcctcatcgtgcgatttgattcattgaggcttatgccttgtttccttcctactcaatattacgtgacgcgaactgcttgttataaatcgagaattgaagaattttaatggtacaacgaatgtggtacgagatgtttctccctgaatagttgattaggctattgtcgttgccttgtggaaggatatctcgtcattttggctcagtaacagtattcctgagagctttgaggctattcacagattgctatgatgctcacgattggttattgcatagtattgaattgatggtaggatatttgcctatgtgttggggcggtgaatgatttgaaaggaagcctactcagtgcatgattcagagattagatatctcatttcgggcagaggaaaagcaattggcctatgaatgtccaaatttggggtgatggagtaacgagacttggtaatttcgagcgtgttagaatttttatctacgatgtagtgttgtcgtcctcgattgtatatgttatgtttgccggtgttatggtcttctgcaattcgcccttggggaaagatattgtgaaataataatggagaaacgactattggatatcgcggggtgcggtggttcaggattgaaccagtgtttctaatgctgacggctcgagaaagatgatctccagaaaggtttaaagttagtagcgatttgtgggttcaagttctacgaagatagattttgttgaggcaacatctgagcagcaaaggatgaggaagaacatgtggggagtgttaggcggtggttaaaatttctaaaacgccaggtataagaagcaaaggtcgagttgtcgattaaaggggtgagatccgccaaagtgggagagtggcagagttgcataggggcttggtggtaggatgaccgcacactttaagaagagtttggaatgatttgggaattttagagattgaagattggggcctacgaatttaattgggagtgtgggatattatgcagcaagagatttgatataacggaagggatctgcttgaaatgaagaaggatacaacataacattgaattgaaaggatgctgccgcatatttaattaatgtccaggaggggtgaatagacttgtgcaactagagagtgagctcagaattaggatgggttatttatgtcgtagtgattgtaccccgtgcagcaacattggaagatgtcgggaagtgatttccatgggtgtgttattccctgtgagtaggttagcggtcacgtggttggcaaagcttctacgaaggattttactggccattcgggtaagaggtcgaatatgtgcatgttgatggaaatttagggtgttcatgaagggctaatggaaggatttcaaggaatctagcagtttaattgcgcgaggtcatgtcactaagagataaagaatcttggtgaattccagaggtgtgtaatagtggcttcaagctaagtgggagtgtcccactgtctacggttggattgcatggtcttctatttgtaaggtttaggattaccaacatattggtgagttatttcagctaagggaaagaacataagtattaatttgagtgaaggaattgttaaaggtgtgctatagttggccttattggctcatgttcgggctttgggaagatttggaatttatgcttcatacagagctgatttacaagggaagtgattcagtcaggtgcttcgtggagatgggtgttcatgtgaataacggtcttaggggattcaaaggttaaagtgtggtgcctaaggatttcgagtccataagtatggttaagaatcaagcttttgtaaaagattatgataagaggcttggaatgttctatgatattttcaacttgcagtgtggcattgggaggaaatgagaaaaagacttcggattcgtagaggaattatcaaaacggttgtatcagttaaagatgcgaatgtgcatgcaaggagggtatgaaacggttcatgggtttggagataatatggtctcgtggaatggggttactcaagatgagtgcagatttaggttggtgatgtaaggaatgaagctattattatctctaaggcaaattaaggaagaattagaagaagttagattgattagccatggttgaattggcataatggtgtcggtgatcagttccttcagcgtgattaagttatgcatgtgatttgtggcggtacatgcgaggtttgacggccgccataattgattttatttggaagtattcaagtattatggccttgttatgtgtaggcggatcccggaagggtcatggtggtttagaccactacttgaggatttgaatgttctacggttatgcgaattcactcgcgtgtagctatggttctcttggaatgagttaggtaaaaagtttctatgtgatgaagtttttaccctaatagtggttcaggagttatgatgaaatttttgtattatcgcatattggcttgttaggtgcagtgagcggtatgaaatttgaaagtgaggatcaagtttgcggttctgtatttgacaaggatgtcacgagctcggatgagcaagaagggggtttggatatttggagtaagctgttattgtcttcagcattacctaagatcggtattttgtgtcggaggcttacattttggttacggattcttgatatgctttacaatattagtgtgaccggtggtatagatgtgcaaactctttatctagtgcggaaggtcgtgggagcgtatctcatgggaagattgtataagtgtgacatgtagtcacttgattgattaaatatttaaaccaagtacgaaaatatgactaatttgagaatttatgcctagaggacactcgacttattgggttatggattgtggaggattgccccggttatgatggtagttcgcatgtgttatgagaaaaagggagttattatgaaccttcgaaaggttattagactagttcagtttgatcagaatcaacttgaggtctgtggatggatttaaatgtgaatatgggatatatatcaggccagatgtgctcatttcagaaatgcgctcctttggacaagtagtcggggtactatttcgtcgtcagctatttcatgaaatgatatatggcgctgtatgagttgtaagacggcttggtgaatttcttatgtgttgaggttccgcgtagagatgatgttataggagcaggatgtgtctcgagatttagatcgtatatggcacctcaattgttcttgagttttgtagcctatggcactatatgtctccccagggatggtattatgcaattagcatgcttgtgatcgatattcggtattttgttgtaatgagcaatttagatcgatgtatatctccttatgtgaattctatgtgttgatcgggtgtggcgctgccatgggtatgttatttggatcgggttgcatgccgcaatagtgtgatgttgagtacagttttctatatgctatttttgtatgccttgtttcccattttcttaaggaaagtccatattagtacgtgagttgagtaggtccttccagatttcgttttccttttgtcatgttcgagttcatagcctattgacatattgtggcatcatatgagacttttgatcatgtccggagtggcttattgcctgagtagttcgtactgggtgagacgagatcattggatttaggatcagtgaaatctgactatatgaagtatattaaatagctaagaccattatttggttcagaatgaggtgatggttcttgtcaggagtatagacctaatgatttgttgattcggcagttggttatgaatttatacacatctcttccgtcgtggcggtattgtaagagttagagaaagacctatgtatgtcatgaggtgcaatgggagcatcaggttcgtggaatttcgattattatgcttagagaatgttattgtggttctgtgaataaagcagtacaaggtgtgaatccagcaaaggtatgcagtcatattctggtacatcgtgcgtgatttatacagttagcgtatgctggaaataagcctggcagagaattctggattttggaattgggctctaaggcttatttgcctaagtgaaaaagggtatcttcggattgatcgagctagggtgcctagctaagttgtggtagcacgagtaggtgctcgaggtgttacgcagtgatttcgggcaaccccaatgtagttcttagcacgtttgaggacgaacgtatgtttaagtatgaaagaatgtaacgacccgaccggtcattttgagctatagtgcgtcgttcagcagtttgaagccataagcagcttcacttcaggtattgtgacttgtgcgcacggtcagaattgatttctgggaagttcggagttgatttggaaagataattctcattttcgaagctttaagttgaaagacttagccaagattggatttttgagtaaacaacctctacattggtatttgaaggttccagcaggttcgtatgatgatttcggactccggcgtatgtccggatcgagttttggatgacccaagagtgatttggcgattattgtggaagttagcattttggaagaatttcataagtttgggttgaagtgcatttcgatgtaatagatgaccatttgggattctgagtctgggagtagctccgtatggtgattctggagttgggagcgcgatcagaagtgaattcaaaggtccgtgggtcattttggagtcatttggctaaagatagaaatttgaaggttcttgagaagtttgaccggaagtggactttttagtatcgcggtcggaatccattttcaaaagcttgagtaggtccgtaatgtcgaatatgacttgtgcgcaaaatttgaagtcaatcggacgtgatttgataggtttaaacatcgaaagtagaagtttgaaattctaaagttcataaagcttagattggaggtcaattcatatttttagcgtggtttgatatgatttgatgcctcgagcaatcaataatgtgttttgggactggtcggtatgattggttggggtcccgggggcctcgggtggattctgggtggttaatggagagaaaatggaatttggagaagtgctgaagcatctgcttctatcataacagcacttggggttggtcgaccacaggtgcgagaccgcagaagcggtcgtagcctcgcagatgtggcccagagatggccaggccaaaccatagaagctgctccttagctgcagaagtggcttcgcagatgcgtcttcaagaccgcagaagcggtcccaaccattttagccaattccgtagatgcggcctcccttcacagttgcggtcccctaaccgcagatgcggaaactgcagaagtagtcagcttcatttaagtcgaaccccagctatttttgaccatttggcactcgggtattgagcgattttggagctcttgagaaagtatttcacatagcattgtgaggtaagttcatcccccttatctctaagtttaacactcgagttttgctagattaacaactaaagatttggagaaatcaaggggttagagctagacctagggttttaataaaacttagattttaccacaaaatttgttatgaaatggattagaaatcatatattattgatccttgggttatagagaacaacttccttggaaaaatttcggaatccgggcacgtgggcccggggatgaactttaggaaccttgcatttagggttgggaaattggtttaataattacactatgaacttttgagcatgtattgactagttcttaccctatttgaatagttttggatcactcggctccaaattcgaggtttgagcgcgttcttgagtcggaatataggcttcagagcgaagtgagtctcctttctaaccttgtaagagggaattgtccacataggtgataataattggttatgtactcctatttgtgggggctacgtatgcacgaggtgacgagagtccatgcgtagctactattatgtttaattccgtgtagtctaggacccaaaagcatgctatacttggactatttgtaatcttaatgacagctgaattgcttaaatcacatcgaattagtaaatgaatttctaaaagaatttaaacttcattttcttaaattgttaaaagagaattggcttttctttggataattgttccatgttgacttcttgattgactgtttgtgtatgtttacctttggaacaggccgaatgcctcggtagattaaatagatgcatctattgttcgtgccgttcgaccctcggcagtgcacagtataaatattgttggattgcgctgtacgacctcggcatgatatgcgcatacttgtattacttgcctgagaatgttatgtgataatatttgccttccttggccagacatagttgataagcataatgaaaagtaaaccttggaaatccgtatttatttgagatgttgtttacctgctatctagttttacgagtttataattgctttataaaaatccatgatttcctcacattttcactatattattattggaccactaggaaatgtcaaagtcgacctctcgtctctacttcttcgaaattagacgggttacccattaggtacacgttgttttcgtactcatactacacttgctatgcatttttgttgcacacgcacatgcatctctagtggcctagtgggcgtagcggcacgattgatacggatacctagctgagttgcacttcttgagacgacccgcagccagtagtgtctctttcaaattactgtatttactttctgtccaatattgtattttggacggttgttgtactacattatttcctagaaattgctcaagtacttgtgaaatcgggttctgggatgatcacgggatttttcagtagttaaattttgtaaagacatcctcatttatccaacgaagtttattatttattatttatttgtttaaaggaaatgatttcaaaataattaaaatgagaaattgctagtaaattgtggttggcttgccagacagtggtgtccagcgccatcacgacccttagtggattttgggtcgtgacaaaaatggaggaaaatggccaagacacggatttttaaagaaccttactgcttccagcaattccgcacctgcggtcacacgactgcttctgcagtttcacaggtgcggcccctctaccactcctgcggtttctctctgggctcccctttgcacttctacgcctcgattcccgtagctgcggtcacgcctctacggtgagatgactgcatctgcggtccttatacttccatccaaaaattgcatatacggctctcctagccacttatgcggctccgcacctgcggcccaagcctcgcaggtgcggttacaccagaagacagctgctacacttcctcttccaatttgaaaaattgatctgttaatcattcggaatccacccgaggcttccggaaccccaaccaatcatgccaaccagtcctaaaatacattatggactttctcgaagcctcaaatcataccaaacaatgctaaaatcatgaatcgacccccaatctaagcttaaggaactttagaatttcaaacttctacattcaatgacgaaacttatcaaatcatgtccgattgacctcaaattttgcacacaagtcatatttggcattacggacctactccaacttccgaaattggattccgaccccgatatcaaaaagtccacttctggtcaaacttctcaaaaaccttcaaatttctatatttagccaaatgacaccaaaatgacctacggacctccgaattcacttccgatcgcgcccccaataccaaaatcaccatacgaagctattcccgaactcggaatctcaaacggacattgataaccctgaaattcacttcaatacaaacttatgagatgcttccaaaaatgctaatttccacaataggcagcgaaacgttcccgggtcttgcaaaacccagtccggacatacgcccaagtccgaaatcatcatatgaatcagctggaaccttcaaatcccgattccgaggtcgtttactcaaaaatccaaccttagtcaattctttcaacttaaagcattcgaaatgagaattctctttctaaatcaactctgaacttcccgcaattcaattccgaccgtgcgcacaagtcatagtacctgaagtgaagctgctcatggcctcaaactgctgaacgacgtgctagagctcaaaacaaccggtcgggtcattacattctctcccacttaaacatacgttcgtcctcgaacatgctaagaactacgctggggttgcccaaaatcattgtttaacacctcgagcacctaccagtgctaccacaactcagctgggcaacctagctcaatcaatcttaagataccctttatcacttaggcaaataagccttagagcccaattccaacatctgaaattcactacaaggcctgttccaacatacgctcaccgaatcaataactacacgcagcaccaaaacatgactgcataccttagctgaattcacaccttgcaccattttactcacaggaccacaataacattctctgatcaaattatttgaaattccatgaatctgatgctcctattgcacctcatgacattcaaaggtcttgctctaactcttacaatactgccgcgatggaagagatgtgtagaaattcataaccaattgctaaatctacaaatcattgggtctatactcctaacaagaaccatcatctcattctgaacaaaataatggtcttagctccttaatatacttcatataatcagattgcactaatcctaaatccaatgatctcgtctcacccagtacgaaatgctctggaaataagccaccccgtcgtgaccaaaagtcttatataatgccacaatgtgccaatgggctaccagctcgaacgcgatacaaaaggaaagtgaactctgaaaaggaaatccaattaccccggtcgcaactaatacatgcgacgtggtcaacataattaaacaaacaccccgctcgcgaatcatacatgcgacacgggcacacaactaataagagttttcctcagaaagataggaatcaaaacacataaaaatagatatagaaatctgtactcaatatcacactgttgcggcgtgcaacccgatccaaacaacatacccatggcggcgtaccacccagtccacccataaaattcacataatgagatacataccgagccagattgctcattacaacaaaatactgaatgtcggtcacaagcacgctaagtgcattataccatccataaggagacatatagcgctataagctaaaaactcaagcacaactgaggtgtgatatacgatctaaatctcaagagccattctgctcatataacattatctctacgcggaacctcaacacataagaaattcaccaagctgtctcacaacttcacacgtcacaatatttacatgaaatagctgacgacaaaataacacccagactactcatccataaggagcgcattgctgaaatgaatacatatggcctgatataaaacccatattcacatttaaatgcatccacaaacctcaagttgattctgatcacgctgaactaagctaataacctttcaaaggtccataataactacccttttctcataacacacaagaacaaccatcataaccggagtaatcctccacagtccacaacccaataaaccgagtgcccttcaggaatcagttctcagtttaacgacatcaccacaatctttatacttggtttaactcttcaaacaatcaagtgactacatgccacacttatacaaccttcccgtggggcacgctcccacaaccttccgtaacagataacaggcttgtgcatccaaaccaatggctgcactaacgctgaagagcgatcaataatccttaaccaggatgcaaagcctctttcacaaaacaccgatctccggtgacgctgaggacattactagcttactttgaacatcccaactcctttcctgctcatccaagctcgtgacatccttgtcaacactgaactacaaccttgatcctcacttcaaattccataccactcactgcacccaacatgccaatatacgatagaacacgatttttcatcataacttcggaaccactaataaattaacactacatcatataaaaactttttacttaactcatttcaggagaaccatcacaacacgcaggtgaattctcataaccgtagaatatgcaaatctccaagtagtggtctaaaccaccctaacccctccgggatcctcctatacataacaatgctataacactcgaatacttccaaataaaatcaattacggcggccgtcaagcctcacacgtacagccacaaatcacatgcataacttaatcacgctgaagaaacttatcaccactaccattatgctaattcaaccatagccaacaaatctaacttcttctaattcatccttaacttgcttagagataataatagctccattccttacattaccaatccaaatctgcactcatcttgagtaactctattccacgaggccacattgtctccaaacccatgaaccatctcataacttccttgtgcacatattcacatcctcaactggtatacccattctgataatccctctacgaatccgaagtcttttctcattttcctcccaaatgtcacactacaagtgaaaacatcatagaacgttctgggcctcttatcataagtttctacaaaagcttgcttcttaactgtacctataggctcgcaatcattaggcaccacactttacccctttgaatccactaggaccgttgttgagagccacccgctctgacttggccccgaatataatcaactccctgaatcttttatcacatcaataccctctcgacgaagcacccggcataatcacttcccttgaatcctgcatctataaaaggcataaatccagaatccttccccgcgtctgaacatgagccaataaggccaaccatagaacacctttaacaattcatttgctcaaatctcctcttatgttactctctcttagctaaaataacccactaatatgctaataaccagaaatgtcacaaatggacgaccatgaaatccaaccataggcgttgggacactcccacatagcttgaatccactatcacacaactctggaattctgtaggattcattatctcttattgacataaccttgcgcaatcaaccgccaaaattcaagtaatctttctataaaacccctttttatactctgaatcatcaaccacattcgcacgaccaatttttttgttgtataaccaatagaattctttgcagaatcttcgccaaccatgcgatcgccaatctgctcactagagataccgcacctatggaatttacttgccgacatcttccaatgctgctacacgagatacaatcactacgacatccataatccatcctgagtctgagctcactctctagctacacacccttcgtggtcatcaattaaatgtgcggcaacatctatccaattcaaagttatgttgtatccttcttcattttgagcagctcctttccgttatattaaatctcctgtcgcataatagcccatacttcaatttaaattcgtagaccccgatcaccaatcagtaaaattcccaaatcattcaaaactctccttaaggtgcgtagtcatcctaccgcaatgtccatatgcaactccgcaactctcccactttagcggaaatcacccctttaatcgactactcgacctttgcttcctatacctggcattctagaagttttgagcactgcctgacactccccacatgtccttcctcatcctttgatgcttagttgttacattaaataaaatccatcttcgtagcgcttgaaccaatgaactgctaccaactttaaatctccccgaggtcatgtttcttgggccatcaacactagatatactgattcaatcctgaaccaccgcacatcgcaatctctgatagtcgcctctccattattattttacaatatcctgccccaaaggcaaattgaagaaaaccataacaccggcgaactaaaatattcaatcgaggacgacgataccacgtcacagatgaaatttccaccatgctcaaaaataccaagtctcattactccatcaaaccaaacttgatcatttatagcccgattgcctctcttccgccgggaaataaaattctgaatctctgaatcttgcattgagtagacatccttccaagtcattcattgcttaaatgtatagataaacactctaccattatatcaatattttccgataacaatgcacgaatcgccataacaattaatggcaaatcttaaaaccttaggtaatactgaaactaagctaaaacgacagaacgaccttccgcaaggcaacgacaatagcacgatcaaatacgcaaggaggaacatcccgcaccacatctatagtaccattacattttctcagtccccgatttttaataagcgcttcacatcacataagtttgagtaggaaagaatcaaaggcataagcctcaaaggaatcaaaccgcgcgatgaggaatcaagaagggaggtgcttctaacagtcctacagcctctcaaagataagtacaaacgtttccgtaccgatctgagagactctactaaacttgctcatgacttgtgagacttaagggaacctagtgctctgataccatgttgtcacgacacaaattcaacaatgggtcatgctggcgccgaacaccgctgtcaggcaagccaaccaaaatacttaattaaattctcgttataataattttgaaaactatgattttccttcaattttataagtaaaagataatcatttcaaaacaagtatgaatgttaagaagttaatacaagataccccataatcatcccaaaacccggtgtgacaagtgcatgagcatttactagggaatggaataaaatacagtaactgtccggaatacaaagtggacacaaatgaaaaacacagaaaaatactttgaaggggactctgctggatgtgggtcatttcgataaatgcagctcacctatgtctccatatcaaccatggcgctatgccactaaaccactagacacatatgaacctgtgcaacaaaaatgcacaacaagtgtagtatgagtatgaaaacaacgtgtgcccaatgagtatcccatctaatctcgaagaagtagagacgagaggtcgactttgacatttaataatagtccaatgataatatagtaaaagtgtgagtaactcatggatttcataaagcaaaatttaactcgtaaggccggagagcaggtaaacaacttctcaattaataaaggatttccaaggatttacttttcattatctttattaatttatctcttgccaggaagggcaattatcaacatttaaaattctcaggcaagcaatacaagcatgcgcatatcatgtcgaggtcgtacagcccgatctaacataaatgtaaaatgtacattgccaagggtcgaacgacaagaaacatagatgcatctattaccccgatcgtgaatcatacatgcgacactgtcaaatttaaataaacaatcaccatgctcgcgaatcatacatgcgacgcaagtacacatagacatacatgctcaaacaacaaattaagaatttatcggagaacgtttatccaaataaaagccaattctcttttagcattttaagaaaatgaagtttaatcttttttttttgaaattcatttaccgattcgataggatttaatcaattcaactgccaacaagattacagatattccaagtatagcatacttttgggtcctagactacctggacttacatataatagtagctgtgcacagactctcatcacctcgtgcatacgtagcccccccacaaatagaagcacttaactaattatttcacctatggggataattcccttttacaagttagaaaggagactcacctcgctccaaagatccacaaccagcattccacgacctttcggagacttgaatcgatgctaaatgctccaaaactagccaacagatatgcaaatccattagtatattctcaattactcattacaatctaatttataaaaaatcctaatcccgatcgaaaggttgccaagattgccctcgggcccacatgcccgaattccgaaatttctcgaagataaagtttacccatgaactcacgaactcaaatatatgattttctcctaatttcatacccaaaatcatggacaaaatccaagaatatcaattttctaggttttccctcaaccccaagtttctaccaatttcatgctaaaatacctaacaaaaccatgtatttaacttacaaggggtgaaattaaattacctaatgtttgatgacgaaatccctctctccaatctctccaaaaatttcccaaacaagattaaatggaggaaaatggtcaagacacccgatttttaaagaacattactgcttccagcaatttcgcacctgcggtcacatgaccgcttctgcggttccgcaggtgcagcccctctaccgcacctacggtttctctccgggctcccctttccacttctgtgcctcgactcccgcaggtgtagtacctcttctgcggcgagatgactgcatttgtggcccttacacttccaacccaaaatcgcatctgcggctctcctagtcgcttctgcggctccgcacctgcggcccaggccttgcaggtgcggctacaccagaagacaactgttgcacttcctcttccaatttccaaaattgatctgttaaccatccggattccacgcgaggccctcggattgtcacgacccggattttctaccctcgggagtcgtgatggcgcctactaatgtgatctaggcaagccagctgtttgaataaattacctttttacccatgttatattctttaacaattataaagaaataacgtgtagacagcggaaattacactaagcggaacaaatacccaaactatctgaaatatgtatctaatacaactatttaggcctcgaccacccagaactggtgtcacagtttcacagatgatctaagaatactacatacaaagtctgaaagataaaatatacattgtttctgaactaagtaaatgaaacaagagtaaatggatagagagagatgtcagggcttgcggacgcctgtaggactaccttggatctccgcgtggactgaaggtagccacccaatctatggtccaaaagttgctgccgcgggatctgcagacagtggagagtgtagtatcagcacaacctaccccatgtgttggtaagtgcctagcctaacctcgacgaagtagtgatgaggctaggaccagactaccaaataaacttgtgtaatttaactaaatacaatggaaaagaagaacagtaatatacagtcacgtatgggaggggtaacatgctgcagggaactatcaatttagaatagaaagacaacgggtaattaaaagaaacaacatatcttagatatcaacgaagaatcaggaatcaataagtgcacgtcatcacctttcgtgcctttactctcgtcctcacagaaacaatcaaataatggaaatgtgcacggcatcatccttcgtgcctttactctcgtcctcacagaaacaatcaaataatggaaatatgcacggcatcacccttcgtgcttttactctcgtcctcaccatataatcaatataatcggcacggaatggtacatcgtgcggcacgacatcacccttcatgattttcactctttcctcacaaatcatacacggtatcgcccttcgtgctttaacgctctctcactaaaacaatacacggcatcacccttcttgttttaacactctctcaccaaaacaatacacggcatcacccttcgtagtttaacactcttcctcacccaaacaacaatcacaaacaatagggcaagggaataaatgaaattgcaataagaatcccggcaagggaacaatatctcaacaatcaagtcccggcaagggatcaacatcaaaagaaacatcaacatcccgacaaggaagataacatcaaaagcaacaatatcccagcaaggaggccaggtaataattctcttttttttctcacttttacttcacaactcacttcacaacttgagacaatgctttaaaagattcaattaccacttatactttcatatttcattgtacaacttgagccaacactcctcaatgttcaaatgtcacaattacttccacaaactttgcccaacaatagaaatcataatcaaagcatgaataatacaacgaagtcataataatcacaatataagactcatgggcatgcttgacaccaacgtttagatactcgtcactatgcctatatgtctaactcgacaaataccgcatagaaaataggactcgacttctaattcctcaagctaaggttagaccaaacacttacctcgatgccgcgaacacaattcaagtctcaacaatcgatttcccttttgattccaccaccatatcgctcatatctagccacaagttacttaattacgtcaataaatgctaaatgaatcaattctaatgcatgaaaatgaattttccaaagttttacccaaaaagtcaaaaattgccccaggcccacatggtcaaaacctgaggttcgaaccaaaacctgactacacattcccccacgaactcaaatatataatttgttttgaaatcggacctcaaatcgaggtccaaatcccaaatttttgaaaaaaaataagttctacccaagacacccaattttccccatgaaaatcattgattttgagttgaaatcatgtgaaaagatgttaaagagtgaagaaaactagttagaaataacttacaattgatttggagaagaaattgcctttgaaaaatggccctagagtgttttggttttgaaagagtgtgaaaaatggttgaaatgcatctaagtcatgaatttacaggtctctgatgttgcaattgcaatcagggttcacaattgtgaacccttcagaattctgagactttcacatttgcgaaaaaatttatcgcatttacgaccaccccttatttctgaggggttcgcatttgcgaagcaggcgtcgcatttgcgactggggccttccgcatttgcgagccaaatggttgcatttgcgatcaggcctgaccaggcatttgttcgcatttgtgatgaaattctcgcatttgcgagccaggcttcgcaacctgatcataccagctaaaaacctaaaattttcctatgtccaaataccacaccgtgacctatccaaaactcacccgagccctcggggatcgaaaccaaacatgcacaccaacctaaaaacatcatacggactcgctcgtgcattcaaatcactaaaataacatcaacaactatgaatttagcatcaaaatcatgaaattcttaagaactttaaatttcccaatttcctcaaataaggtccgattcatatcatttaatgtctgtttcataccaaaattcacagacttatcttaaatcacacataagacctgtaccagattccgaaaccaaaatatgggcccgaaacgttcccaggtctttcaaaacatagtccggacgtacgcccaagcccgaaatcatcatacgaacatgctggaaccttcgaatcccgatttcgagagcgtttacccaaaaatccaaccttagtcaattctttcaacttaaagcttccgaaatgagaattctctttctaaatcatctttgaacttcccagaattcaattccgaccgtgcgcacaagtcataatacctgaagtgaagttgctcatttcctcaaactgttgaacgacgtgctagagctcaaaatgaccagtcgggtcgttagagtaagtaaacttttatttgattttgtaaactcttttttgttatttagataaacatagacgtgtaccatatatattacatttattttaaaagaatttcgttttattcaaatctagataccgtgtttcaaagaactatacttataggattttaaatatgaaagagttttatagttatatgaagtagttttttttgttgctagaggcgaagtagtatttaaataattagaaaaaataaaataaagttcctaacatgattgcatatgaaaacatgataaaataattatttttaatttaaattcgaattttagaactttatctataaattaaaaattatcttttaattcaaattcatttataaatatatatttgtgatgacccggccagtcgtatcatgaattaccgctctgtttcccccatttctacttcatatgcttcattatccgtgttttatgtgagcgagttgggtagtttgcgttcggagtggatttggtaagaaatgagacacttagtctcttttaagaaggtttaagttggaaaagtcaaccgggcgttgacttatgtgttagagagctcagatgtgagttatgatggttcagttagcttcggaaggtgagttatgacttaggagtgtgatcagaattggttttggaggtccggtgtagaattaggtttgaattggcaaatttagtattttggtgatttccggttgataggcgagattttgatacgagggtcggaatggaattacgagagttgttatagcttcattatgtcatttgttataaatgtgtaaaatttcaggtcattaggacgtggtttggttgggtttttgatcgaaagcgtatgtcggaagtttttagaaaacttaggcttgaattcaatgtgaattgatggatttggtgttgtttgaggtgttttgatgattggaacaagtttgaatgaggttttcggatgtattgggcttttggttgaggtttcgggggcctcgggtgagtttcagatggtcaatcggaccattttggaatttaaaagttggagaaaaatctgcccagctgttgcagagaattatctcttcacgttcgtgaacggagccttgcgttcgcgttgaagaatttgaggaaggccagaattaagccttcgcgttcgcgagaggcgcctcgcgttcgcggaaggctaggagtttgtgcttcgcatttgcatgaggctctccgcgttcgcgtataaggatttggggtccagtggaatttgcacttcacgttcgcatcaggtatctcgtgttcgcgaaggtcaaggcggaagaggcatcgtgttcgcgactggcatgacgcgttcacgtaaggtaaaagttggtcaacataaatttgtgctacgcgaacgcgagaggttgaccgcgttcgcgtaaaaggaaagtcagacctggggagaaagtttataagttctttcatccgcgattttgagtcatttttcctccatagttgagcattttgagagcttttttagggtgattaaagaaggattcaaggagaactgattgaaggtatgatttttgaacctaaaacgtgattctattgtgaaatcaacttagaaattcttggaacttaagctaaaaatgtaagaactagggtttgggattttgaacttttaaattgggatttgaaggaccatttgaggtcggattggagaacttttgatatgtatgaactcgtggggtgataaggaatctaatgatgtgaaaatttctgagttttgagaagtgggcccggggctcggcttttgctaatttcgggatttttttatatttttcgattgttttcgcttgggctttgttcccttagcatattgtgatgtattcgttctgattttggttagatttgacccgcgtggaggccaattcgagaggcaaaggcatcgcgagctagagttgtagccggttcgaggtgagtaattattgtaaatgatgtcctaagggtttgaaaccccggattgcatatcgtaatgctataatgtagtgagacacgtgcttgatgatgagcgtggggtcgtttactattggggattgtgatttggtccgtcccgattgatgattttaccgcgtatttgactaaaacttgtttgttatcattataatttgggctgattgccatatttgggcttcgtgccaactatttgaaccctccggggatttttatcactatttcctcactatattgatttatcacttgaactcagtcctgttgatatttattgtttacaaactcaaccacttttactcatatttgaaacttaaatgatgtttctaaaagatgttttgggctgagaactactgatttactaatgcccgaggggcttgtgatgattttcggactgagtgtggacgaggtccatatttgaggatatgctgagcgatatgaagccgagggcctaatatacttttatacgccataagatggcttgagtgatgtgaggccgagtgccgagagatgatgccacaaggtagcttgatatagcacttgggctgtaaggggtccctctggagtctgcacacccacagtgtgtgcgggtacccatcatgatttgagagtgagcccgaggggctgatattgtattgagagtgagcccgatgggctgatactgtactgagagtgagctcgagtggctgatattattttgagtgattgttactgtgcctgaggggcgtatttctacttgttatctacctgctaaattacctgttttacttggtttgaaggaatttcatttgatttcctcactgatttactgctttaagtgttttttactgcttgatatagaattgctttgtgcctttacgtgttttttttgctttcagtcattatttatgattattactcactgagttggggtactcacattactccctgcaccgtgtgtgcagattcaggtatcgtagagtccgctcctgagtgctgatcctcctagtccagacagtgttttcagagactacgaggtagttgttggcatccgtagcccccgtgcctcccttatattactattttcatgtccttcaacttctgtatcggatttcatatctagtagactggtatccggatttattagtttctcatgacttgtgacaccccggtttaggatgtgtcgggatggtttctactgttgttatcgttatttctgcaaattatggttattatatcatgttttataactatttatggtatttaactatttaaataagttgttctgttttggtctggctggccttgtcttcacgagtcatgagcaggtttagtagagtctcacggattggtacggagacgtctgtatttatcctcgagaggctgcagaacctttaggaaaaaacttcatatttttgacattcttgtggtgcgaacttgtggtccgagtactaaacgtctgttatcctattctctcacaaatggtaaggacgcgagcaccggatgaggtggacaaccaccagtaccacaagttgagaccactagaggccgtagacatggtcgtagttgtggcagaggcagagcagcgagggcagcacctgtagatccaccagctgccctagctccggatcaggctccagctatggatgctccagcatcaccaattcaggccctagttgtggccatcatgattctgagtcttcaggaggccttggcacagatcttatcagtttgcactagcctggctcaagcagttcagccactacagcaacaactatttcacaagccaggggaggcaatcatacccttactgcttgcacacctgagtaggaagtacagggacttcagatgccgggggcacctccagcccagccgggtgcaccagctcaagagtttgcggtgccagttatgccggcgtcatcttgggaggattggtagactccatcctccatcattcaatggtattgagggtgaggatacccaaagctttctagataagtgtcagcggatgctccatacagtagggattcttgagtctagtggtttggaatttactacttttcagctttctggggcctccttcacttggtgggaggcatatgagaggataggccggttggtgcggcgccccttacttggcaacagttctccactatcttcttggagaagtatttaccgcagtcccgtagagaggagatgcgtagacagtttgagtggttgcgacagggggatatgactgtgtcacaatatgagtcgaggttttctgagttggctcatcgtgccgtttggatggttccgacagatcatgagaggatcaggagatttgttgatggccttaactatcatctccatattcttatgactcgagagagggtgttgggtgctacgttcgaggaggtggttgatatcgctcgcgagattgagacagttcgccgtcaggattgagaggagagggaggccaagaggcctcgaagatcaggaagttatggtggtgctccttcgaggggggcagtttcagcatggtagaggtcgttctttcaggactgctcagtcagcacgcctagagtatcgtggggcatcttcaggtcgtggttctcatgggtctcagcagggcctgctttcactcagctccctcccagcttagagttcatctcgtgccgcgtcggctcagggttcttctatgccgagtgcatcagctagtcactccggtgcggggggttcccttcagtccccttctccagcaactgggagttattttgagtgtggagagtttgggcatgtgtggaggcagtgtcctcgtcatgttgcttgttctccgagtagaagggtcagccctcgacttctgccccagttacttcactacccgcccaaccagttagaggtagaggtcaggcagccaagggtcgccccagagggggaggtcgatcggggggcggtcaggcctgttgttatgcacttccaggcaagccatataccatagcttcagatgttatcattacaggtattgtttcaatctgccacagagattccactatattatttgatctcggttccaccttttcttatgtgtcatcatactttgctcgttatttgggtacgcctcttgagtttcttactttacctgtttatgtatctacaccggtgggcgatactgttgttgtagaccgtgtgtaccggtcatgtgtggtgactattgggggtctggaaaccccagtggatatattgctattgagcatagttgattttgatgtcattttgggcatggattggttatctctgtgttgtgctatttctggactgtcatgctaagacagtcactttggctatgctgtgtgtaccgcagatcgagtggcgtggtatgactgattatgttcctagtagagtgatatctttcttgaaggcccagcatatgattgggaagggttgcctttcatatctagcgtttgtgagggatgttagagctgagactcccagtatttattctgtcccaattgtgagggattttcccgatgtgtttcctgcagacctgtcgggcgagccactagacatggatattgattttggtattgacctgttgccggacacttagcccatttctcttccgccacattgtatggcaccagcaaagttgaaagaattgaaagaacaacttcaagaactcctagataaggggttcactcggcctagtgtgttgccttggggcgcgccagtcctgtttgtgaagaagaaggatggcaccatgagaatgttcattgattatatgcaattgaacaaggcaacaattaagaacaagtatcattttccttgcattgatgatttatttgaccagcttcagggagcgagggtgttctccaagattgatctttattcaggttatcaccagttgaaacatcagggattcaaatattcttaagacaacttacaggactagatatggtcattacaagttccttgtgatgtctttcgagctaaccaatgccctaacaacattcatgcatttgatgaacagtgtatttcagccttatctggactcgttcattattgtattcattgatgatattctagtgtactcgcatagttaggaggagcacatggatcatttgagagttatattacagagtttcgagaagtgtgagttttggctcagttcagtggctttattggggcacacggtatccagtgagggtattcaggttgatccaaagaagatagaggcagttcagagttggcccagaccatcttcagccacagagattcgtagctttcttggtttggcaggctaatatcgccggtttgtttagggattctcatctatcgcatctcccttaaccaagttgactcagaagggtgtttcatttgtatggtcggacgagtgtgaggagaggtttcagaagctcaagacaactttgaccacaactctagtattggttttggtatcagcttcaggctcatataccgtgtattgtgatgcttcgagagttggtgttggttatgtattaatgtaggagggtagagttattgcttatgcttctcgttagttgaagccccatgagaagaactacctcgttcataatttggagttgactgccatagttcatgcattgaatatttggaggcattatttgtatggtgtatcttgtgaggtattcaccgatcatcgcagtcttcagcatttgtttaagcaaaaggatcttaatttgaggcagtggaggtggttggagttgcttaaggattatgatatcactatattgtaccatccgggaaaggccaatgtggtggccgatactttgagccgaaaagtagtgagtatggggagtttggcatatattccagttggggagagacctcttgtagttgatcttcaggacttggccaatcagttcgtgaggttggatatttcggagtctaatcgggtgttggcgtgtgtggtttctcggtcttccttatatgattgcatcagagagcgtctatatgatcatccgcatttgcttgtccttaaggacagggtgcatcatgataatgctagagacgtgaccattggtgatgatggggtgttgaggatgcaggtccagatttgtgtgcccaatgtggatgggctgagagagttgattctggaggaggcccatagcttgcggtattctattcatctaggtgtcgtgaagatgtaccagaatttgaggtagcactattggtggagaagaatgaagaaagatattgtgggatttgtagctcggtgtctcaattgtcaacaagtgaaatatgagcatcagagaccggttgtcttacttcagcagatggttattcctgagtggaagtgggagaggatcattatggactttgttgttggatttccagggactttgaagaagtttgatgctatttgggtgattgtggatcggtttaccaagtccgcacacttctttcgtactacttattattcatagcgattggaagagatatatattcgggagattgttcgattgcatggtgtcccagtttccataatttcagatcggggcactcagtttacttcccagttttggaagtctgttcagcgagagttgggtactcaggtggagttgagcacagcttttcatccttagacggacgggcagtctgagcgtactattcagattttggaggacatgttgcgtgcttgtgttatggaattcggaggttcaagggacagatttctatcgcttgcagagtttgcttataacaacatctaccagtcgagtattatgatggatccatatgaggctttgtatgggaggcggtgtagatctccaatcagttggttcgagcccggcaaggctaggctattggggacagatttggttcaatatgccttagagaaggtgaaggtgattcaggagaggcttcgtacaacgcagtcgtgacagaagagttatgcggatcggaaggtacgagatgtgtcctacatggttggtgataaggtcttgctgaaggtttcgcccatgaagggtgttatgagatttgggaagaaaggaaagttgagtctgcgggttcattgggccttttgaggtacttcggaggatcggggaggtggcatatgagcttgcattgccagccaacttgtcaagagtgcatccagtattttatgtttctatgctccggaagtatattggggacctgtctcatgttttggacttacacacggtttagttggatgatgatttgacctttgatgtggagccaatagctatttttgaaagttgaggtcaaatgatatagcttcagtaaaggtgcagtggagatgtcagcccgtggaggaggctacctgggatactgagcgggagatgtagagcagatatccttacctatttgaggcttcaggtatgtttcttaactcgttcgaggacaaacgtctatttaagttggggaggatgtgatgaccaggccagtcgtctcatgaattacctctctgtttcccccatttctacttcattatgcttcattatccgtgttttatgtgagcgagttgggtagtttgcgttcagagtggatttggtaagaaatgagacacttattctcttttaagaaggtttaagttggaaaagtcaactgcgtattgaattatgtgttagagggctcggatgtgagttccgatggttcggttagcttcgggaggtgagttatgacttaggagtgtgatcggaattggttttggaggtccgatgtagaattaggcttgaattggtgaagttagtattttggcgatttccggttaataggctagattttgatccaagggtcggaatggaattttgagagttgttgtagcttcgttatgtcatttgcgatgtgtgtgcaaattttcaggtcattcagacgtggtttggttgggtttttgatcgaaagcgtatttcggacgtttttagaaaatttaggcttgaattcaatgtgaattgatggatttggtgttgtttgaggtgttttgatgattgaaacaagtttgaatgaggttttaggatgtgttggtgcttttggttgaggtcccgagggcttcgggtgagtttcggatggtcaatcgaaccattttggagtttgaaagttgtagaaaaatttgcccagctgttgcagagaaatatctcttcgcatttgcgagcggagcctcgcgttcacatagaagaatttgaggaaggccagaattaagacttcgcattcgctgaaggctaggagtttgtgcttccattcgcatgaggctctcggcattcgcgtataaagatttggggtccaatggaatttgctcttcgcgttcgcatctgatgtctcgcattcgcgaaggtcaaggcggaagaggcatcgtgttcgcgactggtatgtcgcgttcgcgtaaggtaaaagtaggtcaacgtaaatttgtgttacgcgaatgcgagaggttgaccgcgttcgcgtagaaggaaagtatgaccatgtcacgacccaattcccgaacctggtcgtgatggcgcctttcatgaagacaaggccatccattgaacccaattcatccttttaagacaattaattaacaccattatagtataaacatggtttaataatatccaatagcagaaagtatagataaaatacggaaatccaacccaactcagccctaaccggggtgtcacaagtcatgagctattatagagtttactaaaattctacaaagtatggaattaggaacaaagtctaaagatatcataaataacagaagataagggagaaaacgggtctgcgaacatcatgcagctacctcgataactccaatgaaaactgaacagcagaaaactcgttctatgcctcaggaatacctgtacctgcacacatggtgcagggagtattgtgagtactccgacccagtgagtaataaatataaataatgactgaaggtaagaaaacacgttaaggcacacaacattctatacagaagcactgaaatcacttaaaataacaattcagtgaaatatcatgtgaaaattcttttaaactagtaaaacagggaatttggcagtaaaatgacaagtagaaatctgcccctcgagctcaatatcaaaacaacaagtagaaatctgcctctcaggctcagtatcaaaataacaagtagaaatctatccctcgggctcaatatcaaaataataattagaaatctacccctcgggctcggtatcaaaataataagtagaaatttgcccctcgggctcaatatctcagaacagtatcagcccctcaggctcagaatagtgtgaagcaaccagtcaatgaaataagagcacataattattatggcagataatacagataaggaataaatgcatgagtgtaatgcaatgcatatgacggtaccctccggtacccactgcggagtgcagcccgagccatccatatttatttatcgtcgatggcgctcactgggctgtgtacagactccggaggggctcctacagcccaagcgcaatatcaagccatctgtggcatcaaatctaggccctcggcctcatatcaatatcagtataatcacccaggctctcggcctcaatatcaatataatcaaccaatctctcggcctcaatatcaatgtaatcaactaggctctgcctcaatatcaatgtaacactgctgcggcgcgcaacccgatccatgctcagtccaaaaatcatcataagccccttgggcattcgtaaaacaatagttctcagcccgaaatatcatttagaaatatcatttaagttttcaaatcgtagaaagatggttgagtttgcaaaacaatatttaaaaccttggactgagatcaaatgatatgcaaaatatgcgaaaacagtgatatcaatccccaatggtgctctaccccacgcccattatccggcgtgcaagtcacctcaatatagtgttacaatgtgaaattccggtgtttcaaacactcaggacatcatttacatcaattactcacctcaagacggtcaaagtctagctcgctatgcccttgcctctcaaattaccctcctcgtgcgacgaatctgcccaaaatcacaacgaatatgtcgcattatgctaaagagacaatacccaatcgaaagcaatcgaaaaatatcaaaattcacgaatttgacaaaaacccgagccccgggcccacgtctcgaaaaatcagaaaattaacatcaccggatttcttgtgtcgccacgagtctaaccatacaaattttaccaaaatccgacatcggattggctttcaaatcttaaaaattcatctttaggaaattttagaaaatcatccatttctcttcaaatatcaataatctaaagccaaaaatgaagattaattcatggaatataatcataagagagtcaagaacacttaccccaagaattcccttaacttctcactcatgcccagaatccgatcttgaaagtccaaaaaatgaaagaaaatcggactgctctttttctacactgtccagaattttcggctactgttcacgcgtgtactgtacacggggtactgttcacggtactgttcacggggtactatttctgcaattttcctaagtccgaaatcactctgagacacctacaaaacactcccaagccctcggggctcctaaccaaacacatacactaactcaacaacatcctacgaacttaaccgtgcgatcaaatcgccaaaataacgtcatataccacgaattaagctttaaaatccaagaattctttcaaatttcataaaacatcaaattttccattttaagtccgaaacacgtcaaatgacgtccgttttcaaccaaactttacagaaagtgcttaaaccatatataagacctgtaccgggcgccgaaaccaaaatacgggctcgatacgatcactttctaatcaaatttcatttccattttccttaaatattttctgaaagcaattttactcaaaaattcatatttcgggcctgggacctcggaattcgatgatttttgttcctataataatatgaacatagcccttcagtcgaaactcaattcagagctcatttgcgtagttcaataccatttcgctcgttaaacaattaactcatgatgaaattagaccaaacgttccagatcactcctataattcattatcaaaattctggaagtctcaaaatcaaatttcaatctttagaactaaaaatggacctttggatcattacatgctcttaatcgaaacgccaaaatcttccaaaaactcttccaaaacatatccgagcctcatgggaccccgaccaaacatgccaacataactcataacatcattcaaacttgttccaatcattaaaacacctcaaacaacatcaaattacccaaaactcatcgaattcaagcctaagtttccaaaaacttccgaaatacactttcgatcaaaatctcacctatcaaccggaattcgccaaaatactgacttcgccaattcaagcctaattctacaccgaacctccaaaaccacttccgatcacactcataagtcacaaatcacctcccggagctaaccaaaggataaaaattcacatccgatacctctaactcataagtcaacatccggttgacttttccaacttaagccttcttaaaagagactaagtgtttcatttcttatcaaaaccactccaaactaactcgatcacataagatacggataataaagcataaagaagctgagaatgagaaaaatggagcggtaacctatgagacgatgggtcgggtcgtcacagaccagggcagaaagtttataagttatttcatccacgattttgagtcatttttcctccatagttgagcattttgaaagtgttttgagggtgattaaaaaaggattcaaggagaattgattggaggtaatatgtttgaacctaaaacgtgattctattgtgaaataaacctagaaattcttggaacttaagctaaaaatggaagaactagggcttaaaattttgaacttttgaattgggatttgaaggaccatttgaggtcgtattggagaacttttgatatgtatgaaatcgtggggttataaggaatctaacaatgtgaaaagttccgagttttgagaagtgggctcggggctcgggttttgctaattttgggatttttaaatatttttcgattgttttcgcttgggctttgttcccttagcatattgtgacgtattcgttctgcttttggtcagatacgacgcgcgtggaggccaatttgaggggcaaaggcgtcgcgagctagagttgtagccggttcgaggtaagtaatgattgtaaatgatgtcttgagggtttgaaacctcggattgcacatcgtagtgctatattgaggtgagacacgcgcttgatgatgagcgtggtgttgtttactattggggattgtgatttggtccgtcccgatagatgattttaccacgtatttgactaaaacttgtttgttatcatcattatttgggctgatagccatatttgggcttcgtgccaactatttgaaccctccggggatttttatctctatttcctcactatattgatttatcacttgaaatcagtcctgttgatatttactgtttacaaattcaaccacttttactcatatttgaaacttaaatgatgtttctaaaagatgttttgggctgagaacaactgatttactaatgccgaggggcttgtaatgattttcggactgagtgtggccgagggccatatgtgaggatatgctgagcgatatgaggccaagggcctgagatacttttatacgccacgaggtggcttgagtgatgtgaggccaagtgtcgagtgatgtaaggccgagtgccgagagatgatgccacgaggtcacttgatatagcgcttgggccgtaaggggtccctccggagtctgcacacccatagtgagcgcaggtacccatcatgatttgagagtgagcccgaggggctgatattgtactgagagtgagaccggggggctgatactatactgagagtgagcctgagggcctgatactgttctaagcgattattactttgtccgaggagcgtatttctacttgttatctacccgctaaattacatgttttacttggtttaaaggaatttcatttgacttcctcactgatttactgatttaagtgatttttactgtttgatatagaattgctttttgcctttacgtgttttctttctttcagccattatttatgattattactcgctgagtcggagtactcacattactccctgcaccatgtgtgcagattcaggcatcgcagagtctgctcttgagtgctgatcctcctaatccaggcagtgttttcagattacgaggtagctgttggcgtccgcagcccctgtgcctcccttatcttactattttcatgcacttgaacttatttattggatttcatatctagtagactggtattcggatttattagttgctcaaattatggttattatatcatgttttagaaatatttatggtatttaactatttaaatgaggtgttatgctttggtctggtaggccttgtcttcacgagaggtgccatcacgaccgtgttcgaggttagggccgtgacaatatttaactaaaatagtgaaatttagaataaagttatcatatactattgacatttattagcttgccacttaggttaaccataatgccaattatatatggtaactttcttgatttaatatatactagtattagtacccgcgcggatgcgcaaacactaatcatgtaaaatatttaagttatttgaattgtatgtaaataatcttaaactttacactttcttagtaaatatagatgatcattggatattaactacgtgaaaaaattaaccatttcttctatttttcttttttggtaccattcttgccggtgtcattgaatcctaaatatagtcaggaagcaaaataacaactcatatttatggcaaaacaattaaatgttgagacaatgaatgactctttggataagacttaactcttttactactacttgaactcttatttagtgtattgctatctcttaaaaaatatttctttcttaaaatttcagtttctaaaacattatttttcaatatttattgtttttataataatgtaattgaaaatattattctttattcaaaagtcattttagttggctatgtaaaaatataaaaaattctttagctagtgaattgtttttactccattttgatatttaacattaaccatgttaaatatttgagttatttgaattatatgtaaataactttaatatttaaaccttataaataattatagataatcgtaagatattaattaaaaaagactaacattttttcaattctcgtagtaaaaatttatttttgcactattctcataggtgtcattgaaacctaaaattagccacaaagtgaaataataactcatatttatgtcaaggcacaaagtttgatacgatataaatgattctttgattacgacgtgactcttatactacgacttgaactcttatttgatatgattttatctttaaaaaaaatatttcttttttgaaatttcaatttctaaaactttatatatattataataatgattatctttataataatgctagtgaagatattatccttaatttcaaattcactttaatcggctatctaaaattttaaatgattctttgaccaaatttatttcagtatgactccactttaagtttatcgatatctctagccccagaatttgaatttttaataccctatatatacaaaaagaaatctttgaatcattaaaagtttaattagttgattattattattataaaatattgcatatattatcttaaaattgtcaagtagtttattttcgacatcatacttgtcttaaccttaatgcaaactattcaaattgcattccaattcaaattcgaatatcatattagtttgttagtaatagtgatttttaaaaaatgacatataatgtaaattaaaaaaatattctaagatatccttatcttataatctatgtatttgagttgaaaaaaataatatttaaaatcgatgagattaactttcaaattttttatactgaacaaagatgaaacatacgaagaaatttgttttcatcttttatttctcgtttttagatcttctaacatttttatcaatgattattttcttttatcttacttcttatgtcattatttcttttgttacaaaaaaataatttatttcactataaaaggatgagttttaataaaaattatctacatttgaattttcattatatttttagtctttgattgaagttatttcatatttttcttttggctttatctaatcaacctaaattggtgctcacccaaccacttaaattaaaaaattgaatgatgtataatttatatataatccatatataatatgtgtataatcgtgtattgtcggtatatcatctattttatattatctataaaaagtaaacaataaatatggccgaatattatgtaaatattccataagatttcggtttttagagtttatccttgatataacttttattataataattttaaaactctttactaatgttcaaaaatatcttatatttttattatctttgaattaaaaaaattaaagagtttttttgaaataatttgtttacatttaaaaaaaatatttcacgtcataccaattttttctatatatactctttgttacacttaaaagtcgctatagaaactatcaattagaaatcaatttctctctagttgagtttgaaaaaaaacctttcacataatctaatgattcaaaactaatattcttcaacgaaaaaatattataccctagcaatattggcttgactacatctaaatgaaggggtttcagcttatactttcacgacccgaattttccaacctcgggagtcgtgatggtgcctactaatgtgagctaggcaagccaatcagttaactacttattgctttaaaaacaatataagacgataatatgacaacagcggaactttaaataattaagtggaagataacaattaaatatctaaaatttgcatctattacaactcttaaaatctaaagtacccaaaacctggtgtcacggtgtcacagacggtctaagatttactacatacaaagtttgaagaaaatgacaatatattgtttctgaataaaaggaaaatgaaacaggaaataggagtagaggagacgccaggccggcggatgcctgcaggtctaccttggatctccgcgtggactgaaggtaacctccacactacggtccaaaagcttctctgggatctacacatagtgcagagtgtagtatcagcacaatcgaccccatgtgctggtaagtatctagcctaacctcggcgaaatagtgacgaggctaggaccagattatcaaataacctgtgcagttcaaatatatagatcgaaaagaaataaagaaataaccactaaatatgggagggggagcaagttgtgggggagataacagttccgaatagaaagacatcaagtaatgaaagaaacaatataacttggatatcaacaaagaatcaaaaatcaacaaatgcacggcttcatccttcgtgtttttactctaatcctcacaaaacaaataacgcacggcatcacccttcatgctttaactttcttcctcacccaaacaataatcacaaataatagggcaaggaaataaacgaaattgcaataagaatcccagcaagggaacaacatcaataacatccatatcccggcaagggagataacaaataaatcaacaatagcccggtaagggtgacaatataatgatctcttctctttctcacttttacttcacaattcacttcacaactcgagccaatgctctagaggtccaattatcacttataccttcacaattcatttcacaactcgagccaatgctttaaaagttcaattgtcacttatactttcacaattcgttatacaacttgagccaacgcttctcaaggttcataggaaacaattctttccacaaactttatacaacagttagaaaccatcaccaaggcatgaaagatacaacaaagtcatgataatcacaatataaagattcgcaagcatgcgagacaccaacgtatagatactcgtcaccatgcctatacgtcgtactcaacaattaccacatagcaaataggactcaactcctaatccctcaagctaaggttagaccaaacacttacctcgataccaccaacacaattcacgattcaattatagctttaccccttgattccgccaccaattcgctcgtatctagtcacaagttacttaattacatcaatgaacgctaaatgaatcaaccccaatgtatcaaaatgagttttctaaagttttacccaaaaagccaaaaatctcccccgggcccacatggtcaaaacccaaggttcgaaccaaaactcgattacccattcccccacgaacccaaatatataatttgttttgaaatcggacctgaaatcggggtccaaatccccaatttttttaaaacctaggttctaaccaaaacacccaatttcccccatgaaaatcatttatttgagttgaaatcatgttaaaagatattaaggagtgaagaaaatgagttagaaatcacttaccaatgttttggagaagaaaggttgtttgaaaaatcgcctcttatgtttttggggttttgaaaaatgaaaaataattgaaaatcccgtctaaatatactactctcaaatgccctgtgcggaccgcacaaaatcaactgtagccgcacagcccctgtgtggactgcagtgacatgctttagtattttggccacaactttctctacagatgtccaaattgtgatttctttacctttctggacgctagacacgaagggctacaactttcggttttgaatcatctcaatatttcatgtagatcaaaagatataggcttccgaagtcagaccagtaaacctgtgcggaccgcacaaaatcaactgcggccgcacagtcaccactgcggacaacacaaaaactagtgcgaactacactagcaggttcagagatttgtacttctctgaacctccagtagccatgttttaagcctaagacaccctggaacctacccaaaactcacccgagccatcgggactccaaaccaaatgtgcagactgactcaaaaacatcatatggacctactcgtgcgatcacatcatcaaaataacatgtaaaatcatgaattaaacctcaaaactcaacatttttatcaagaactctcaatgttcataactcttcaatcggaagtccaactcacgtcaaataaactccgttttcaccaaatttcacagttatctttcaaattgtataacaagtttgtatcaggctccggaaccaaaataagggccagataacaatactttcaaacattaattcttttcgttatttcttagacaattcagtaaaacaatttctttcaaaaattaatttataaggcttgggacctcggaatttattttcgggcatatgcctaagtcccatattttactacggacctcccgggatcatcagaacatggttccgggttcgtttgctcaaaatgttgaccaaagtcaaccataatcaagtttttagctctaaaatttctatttctcatatttttacatagaaggctttccggatataggtccggaccacgcacgtaaatcagggtggggaaaaggaggtttttatgcctcgaaacactgaattcacttgcaacacaaaggtcttcacattctccacctctaaaacaactattcttcctcgaatggacataagaaagaagtacctgagtcgggaaaaagatggggataacggctccgcatatcggactcggactcccaggtcgatgcctcaggaggctgacctctccattaaacacaaacagaaggaaaactcttcgatctcaattgactaacctgctggtctagaataactactggctcctcctcataagacaagtccttgtccaactcgacaatgctgaaatctaacacgtgggatggatcgccgtgatatttctgaagcatggacacatgaaacactggatgcacggttgataagcttggcggcaatgcaagtctataagccacctctcccactcgatcaagaatctcaaatgggctaataaacctagggctaagctttcccttcttcccaaaatctcatcacgcccttcataggcgacactcaaagcaatacatgctcaccgatcatgaatgccaaatcccaaaccttgcggtcgtcataactcttttgcctggactaagctgtacgaagcctatcctgaatgatcctgacctattccaaggcatcctgaacttgatctatacccaccaatcgagcctctcccggctcaaaccatcaaactaaagaccgacaccgcctaccatataaagcctcatacggagccatctaaatactcgattggtatctgttgttgttggcaaactttgctaaaggcaaaaactattcccacaagcctccaaagtcaatgacacaagctcagagcatatcctccaatatctgaatggtccgctcgaactgcccgtccgtttgaggatgaaacgttatgctcaactaaatccgtatgcccaactctcgctgaactgctctccagaaatgggaggtaaactgcgtacctcaatccgaaatgatagactcgggcacaccatgaagacgaacaatctcccggatatagatctcagctgatctctcggaagaataatagactgccacaggaataaaatgcactgacttggtcagcctatcaaaaataacccacactgtattgaacttcctctgagtccgtgggagacaaaaacaaagtccatggtgatacgctcccttttccactgaggaatctcaatcttttgaaatgaacagtcgggcctctgatgctcgtacttaacctgctgacaattcaaactttgagccacatatgcaacgatatcctccttcattctccgccaccaataatgctgccgcaaatcctgatacatcttcacggagctcggattaatagagtaccaggaactatgggcctcctctaaaatcaactctcgaatcttatccacattaggcacacaaactcgaccctgcaatctcaaaacttcatcatcacctatggtaaccttcttggcacctctgtgttgcaccgtgtctctaaagacgcacaaatggttatcataatactaccgatctcggatatgatccaataatgaagagcgagcgattgtgcaagctaacacatgactatgctcagaaacatccaacctcataagaaagactgcctatactggctgacttcctactcaaagcatcagccaccacattatcctttcctgggtgatataagatagtgatatcataatctttcaacaactccaaccacctcatctacgtcaaattcaactacttttccttgaataaatatcgaagactcttgtgatccgtgaacacctcacatgccacgccatacagatagtgcctccaaatcttaaacgcgtgaacaatggctgccaactccaaatcatgaaccggatagttcttctcatgaatcttcaactgccgcgaagcataggcaatgaccttgtcatcgtgcatcaacactgcaccaagtccaatacgagatgcatcacaatagactgtataaggcccctgaacctatgggcaatactaataccggtgccgtagccagagctgtcttgagcttctgaaagctcgccacacactcctatgaccatctgaactaggcacccttctgggtcaacctggtcttcagggctgcgatagatgacaaactctccacgaaccgactatagtagcatgccaattctaagaaactccaaatctttgtagatgacgctggtctaggcctgttcatgactacctcaatcttcttcggatcaacttgaataccctctactgatacaacatgacccaagaatgcaactgaactcaaaaggaattcacactttgagaacttagtatataactgactatccctcaaggtctgaagaaccactctaagatgttgtttgtgctcctcccggctgcgggaataaatcaaaatatgatcaatgaagactatcatgaacgaatccaaataaggcctaaacactcggttcatcaaatccataaaagctgctagagcatttgtcaacccgaatgacatcaccaggaactcataatttccgtaccgagtgcgaaaagctttcttagggacatcagatgccctaatactcaactaatggtagccagatctcaagtcaatctttaaaaatattttggcaccctgaagctgatcaaacaaatcatcaatcctcggcaacaaatacttatttttgattgtaaccttgttcaactactggtaataaatacacatcctcatcgatccgtccttcttcttaacaaacaacaccggtgcaccccaaggcgaaatattaggtctaataaaacctttctcaagcaagtcttgcaactgttctttcaactccagtggggccatacgatacggtgggatagaaatgggctgagtgcccggagccagatcaatacaaaagtcaatatccttgtcgggcggcacaccagtcagttctgaagggaaaacctccgaaaacccacgaacaacgggcatagaatcaatagaaggaacctcgacactagaatcatgaacatatgccaaataggccaaacaccccttctcaaccatatgccgagccttcacatacgagataacattacgggtagaatgactaagagtccctctccactctaaacgaggcaaacccggcaaggctaaggtcacagttttggcatgacagtccaagatagtgtggtaaggtgataaccaatccatccccaatataacatagaaatcgatcatgtctacaagcaataaatctacacgagtctcaagacccccaatcacaactatacatgaacgacggactcgatctaccacaatagaattacccactggtgtagacacataaacatgatcactcaaggaatcactatgcataaccagatacggtacaaaataagataacacatacgagtacgtagaccctggatcaaataacactgaagcatctctatcacaaaccagaaccgtacctataataactgcatctgaagcctcaacctcgagcctggttggaaaagcataacatcagggctgggccccactaccctgaactacatctctaggacgacctgctgctggctagcctccacctctagtgacctgaactccacctctagtacatctacctcaacctctagcacctctacccccacctctagctggctggtgggctgtgggacactaggtgcctaaaccatggcacaggaaccctgatgcggagagctactcggtgctcgagggcaatacctagcaatgtgacccatatcaccacaagtgtatcaagccctcggctgctgagactgctggtcctgacacctgaatgaccaccccgaaaactctgaagcggcggtgcactgataggagcaggtggtgtattgtaagactgctgatcagaatactacatttgaggaccacgaccacctaacgtaccgtgagaaacttgaagtgctgattgaaaaggcctaggaggatgacctataccatatgaatccctacctccaaacgaggtaccattgaatcggcctgaatgacgaggtgtcatgtctgacacatgaacacctccctgcgacagaactatctctactctcctggccacattggtcgcctcttggaaagatatctcactccctgcctccctagccatctgaagacaaatcgactgaataagtccatcaatgacctcctcaccctttccctcttggtgggaagtatgataagagcatgatgagccaagtcgatgaatctggtctcatactgggtaacagtcatagaaccttgttggaggcgctcaaactgcctccgataggcctctctttgagtgatggggagaaaattctctagaaatagttgtgtaaactactcacaagtcaagactggcgatccggctagactagataagcaataatctctccaccaagtcttggcggattcagataagcgaaaagtaggaaaatcaaccccattggtctcaactatccccatgttcctaagaacctcgtgacagctgtctagataatcctggggatcctcagtagatgcatcgctgaaagtagtagtgaagagcttggtgaacctatccaacctccacaaagcatcggcagacatagctgctccatcgtcaatctgagctaccacacccagctgaactgctccaactagctggaccgctggagtctgaaactggggaggtacctgctctggagtgctagtagcaggagtctgggctcctcctccatcctgagagacgactggtgctacaggaagcaagcttgcttgggtgacactctccatgaggcccacaagacgcaccagagcatcctgaagaactggggtagcaataaacccctttaggacctaagttaggcccaccgaaactgctggggccggaacctcattatcaaagtcaacctaaggctctgtcgctggtgttgctgcttgaggctaagctttgcccctacctcggcctctagcacggcctcggactcgccctctgaccctcctgggagctactgctaggggctcgggttgctagtcagtgtatgaggaagcgcgtgttctcaccatctgcgaaagaatagagtagaaattcaattagcattaagaaaccaaaccgcacgacaggagagaataaatgtgaagttgttcctaactctatagcctttgggggataaatacaaacgtctctgtaccgatccctcagactctactaagcttgtctatgaactatgagacccacgtaacctagagctctaataccaacttgtcatgacccagattcccaccctcgggagtcgtgatggcacctactaatgtgagctaggcaagccaatcatttaactacttatttcattactcaattattgttttaaaaccaatataagacgataatatgaaaacaacggaactttaaataattaagcggaagataacaattaaatatctaaaatctgcatctattataactcttaaaacctaaagcaccgaaaacctggtgtcatagtgtcacagacggtctaatatttactacatacaaagtctgaagaaaatgacaatacactatttctgaataaaaggaaaatgaaacaggaaataggagtggaggagaccccagggcctgcgaatgcctgcatgtctaccttgaatctctgcgtggactgaaggtagcctcgacactatagtccaaaagctactctgggatctacacatagtgcagagtgtagtatcagcacaaccgtccccatgtgctggtaagtgtctagcctaacctcggcgaagtagtgacgatgctaggacacgactaccaaataacttgtgcagttcaaatatgtatacagtggaaagaaatacacaaataaccagtcaatatgggagagggagcatgctgtggggagatgataattacgaatagaaagacatcaagtaatgaaagaaacaatataactcggatatcaacaaagaatcagaaattaacaaatgcacagtatcaccattcgtgcttttactctcgttctcaccatagcaatcatataataaaaatatacacgacatcacccttcatgcttttactctctttcctcaccatataatcaatataattggcacataatggtacaacgtgtggcacggcatcacccttcgtgctttacaatatttcctcacaaaacaaataatgcacggcatcacccttcgtgctttaactctcttcctcgcccaaacaacaatcacaaacaatagggaaaaataaaggaaattgcaataagaatcccgacaagggaacaacatcaataacatccacatcccggtaagggagataacaaataaatcaacaatagcccggcaagggtgacaacataatgatctcttctctttctcacttttacttcacaattcacttcacaactcgagccaatgctctagaggttcaattatcacttataccttcacaattcaattcacaactcgagccaatgctttaaaagttcaattgtcacttatactttcacaattcattatacaacttgatccaacgctcctcaaggttcataggacacaattctttccacaaactttatacaacagttagaaaccatcaccaaggcatgaaagatacaacaaagtcatgataatcacaatataaagactcgcgggcatgctgtacaccaacgtatagatattcttcaccatgcctatacgtcatactcaacaattaccacatagaaaataggactcaactcctaatccctcaagctaaggttaaaccaaacacttacctcgataccacgaacataattcacgattcaataatagctttaccccttgattccgccaccaatttgctcgtatctagtcataagttacttaattacatcaatagatgctaaatgaatcatccccaatgcatgaaaatgagttttctaaagttttacccaaaaagtcaaaaatcgcccccaggcccacatgctcaaaacccgacgttcgaaccaaaaatcaattacacattcccccacaaacccaaatatataatttgttttgaaatcggacctcaaatcgaggtccaaattcctagtttttgaaaaacctaggttctacccaaaacaactaatttaccctatgtaaatcattcatttgagttgaaatcatgttaaaagatatgaaggagtgaagaaaatgagttagtaatcactttccaacgttttggagaagaaaggttgttagaaaaatcgcctcttatattttttaggttttgaaaaatgaaaaataactgaaaatcccatctaaatatactactctcagacgccctgtgcggaccgcacaaaatcaactgtggacgcataacccccgtgcagactgcagtgacatgctttagtattttgtccataactttctctacagatgtccaaattgtgatttcttttcctttctggaaactagccacgaagtcgtttttgaatcatctcaaaattccttgtagatcaaaagatataggctttcgaagttggaccagtgaacctgtgcgaaccgcacaaaatcaactgtgtgcggatagcacaaaaactagtgcggaccgcactagtaggttcagagatttgtacttctctaaacctccagtagccatgttttaagcctaagacaccccggaacctacccgaaactcacccgagcccttgggactccaaaccaaatatgcatactaactcaaaaatcatatggacctactcgtgcgataacatcatcaaaataacatgtaaaatcatgaattaaacctcaaaactcaacattttcatcaagaatactcaaagttcataactcttcaatcggaagtccaactcatgtcaaataaactttgttttccaccaaatttcaaagttatctttcaaatactataacaagtttgtacctggatcggaaccaaaatatgggcccgataataatattttcaaacattaattcatttctttatttcttagataattcatgtaactacccgaccggccgttttgagattttgcacttttctctccagttttcaggcatgacttgccccgtgtggtatattatgacttatgtaaatcgttggtgttgggtttcaggttaatcgaatgaatttggaagaactgtctcagttgaaagcttaaaatttgaaaggtttgaccaagatttgacttgtttgtatttgatctcggattttaatttttatgatttggttagctccgttaggttatttggaacttaggagcgtgataggaatgcatgttggaaatccgtagaaaatttaggcttgaattagcgaaattgagatttctctctttcctgattgataggtgagatttcgatatagaggttggaatggaattctgatagttgcagtagcttcattttatcatttgagatttgtgtgcaaaatttcaggtcatttggactagatttgatagactttttgatcgaaaacataatttaaaagttcttggagttcttcagcttgaatcccatattaaatttgtgatttgatgttgttgtaagtgtcccaaagttttgaaaaagttttaatgatgtcatggaatgtgttggtacaattgatttgatgttccgggagttccggggtgttttaggccgaaaatcatagttgtagcaggtccagaagggttgcaggcctcggaacccactcgcgcggttcacacaaaaagaagtgcggccacggtatgtgatgtgcggaccacacaaaatgaagtgcggccgtggtaggtgttgtgcggatcgcataaaatggtgtgcggccgcggtgaagaacattccgctggtcctacttcggaagctcatatcttttgatatacaaggaattttgagataactcaaaaacgaaagttgtagcccttcgtgtctagtttcaagaaaggtaaagatatcacaatttggacatttgtaacaaaagttataatcatcatctccaagtattttccctcaaatccgttctaaacccctcgaatcttaaatcccaaatccgagttccaagagccaaacctaaaactcgaggttgatgtgattttatcacaaaataatgttactcacttgttttgacaaagaacaagtgactaacattatttggcgatgaaatcggaaagtcagggtaccaagttgatttctagcttagtcggtgagtttcccggtatcatttctttttattttaatgcctattccaccactgcctcttcttcttcttcttctttgtcattcaacaatttaattaagttttgaattaggtttaaaattgtgaattgtccatccgttttctttagttcatattcatgtatgtcgttaatcaatctaacaactgattttgatttttcaatccagttgaaggttttagtcttttgtttaccgtttattataattgtgataatttaaaacttacgaagcttctcaatagtggtagggtagaaattgcattaatgaattaattaaaagcactaaactagtggataattatgaaatgaaaagttgaattgatagtggtgaatgcactaagttgaacaattatttatagacactaagagacacactgaaaaatggactggatattcaagaatacagagagatagagtacaaagatagagaaaggagagctcagagactttaagagatagaaaatccaaaaaaccaaaaacgactgaagttctgaaactgcactgatttccagcacttttccttgataataattgatcaaattctgtattaagtgggtctttttaatctttttcatgagctaaaatctctgaaagcttcacattctgcactttagttgagaaatggtttgaatttgggggttctaaaagctctgttctaaatttagctgtttggttattgtttgattggttctcggcactgttttatagttgtgactactgctgcttggctactgatctcacatttcttacttcctctcattttccaggtatgcttcagcatttaagtagcatatgagatgtaaagggaagccatgtagttgatttagatagtgaataaaatggcctctattttttaaatgatttgttcgtgtattttcttgtctaaattagcctgattacctggatattattgtattcagtcatgacttatgccgtatattttaggaagatgcttgaactttggttttgttattttaattctaaattagaagaactccttgtcaaatacttgtgtgttgggactattatgattggaatttagtgagtgttgttgttattcgagctaatagtttgagtcttgcatctttcatttatgtttagggttgatcacatgaattgctcgttggaattgttgctagaaactctgtggttcattattaaaattaagtaatgtttggttgattgtgaaatgcatctggttttatcatcagtagggtgggttgttaatgccaaaattaacatgtgttaaagaatagtctgggtccttgttcacctcgacatttcttgtagtcaggcataaggctttgagttctcaatatggttagtgttgaataatggataaagtttcctagctaatacatatagtgtgttaatattgattaattcaaattttaattgtagtttatcttgaactgtaattcattttagcataaaatatgtgttgttgaaaattggcattaattcaatgttggtcgtgcctgcgtgagttcgatccgcgagcccagtataggcgtgatttcattgaggcctgggctcctctcatgggcttgaatctaaagagacttgtaaaaattaaaatatcatattttgggcttgctgagtttcgctagcccaattccctcgtttgtttggttgttaatagcaaattcagttcgggctttaacattgagtatatgttgaactcctggggtttattttctttcgtaattaattaagttctctaaattaattggaggcgagccacattagacgaatcataatttgtagccctcatgggttaattcttaaactcttggttaaaataaatcaaggtgcaccatgccggacaaaaatatcaattgcatggccctctttaattaatattgtttatccttagaaatcgaggcatgccgtttagcgactttttatggcccttgcaaagttgcaaacgcctagttgctttaggcgcgttactttaataatttaccttcctaaactcgggtgcgcatttatgtaacccaaatccaaatctcaacaatattaaataaaacgtgtctcagattgtgggtgcatttcatatggaatggtccaaaaacgcattttatatgacgttgaattttttcaaatgaaagaggtttaaagttaagattgcacataggttcaaaatgttttaagtcagataattaagccgaatacaacagttgagtgaccgtgctagaaccacggaactcgagaatgcctaacaccttctcccgggttaacaaaattccttacccagatttctggttcgtgtactgttaaacagagtcaatatttttcctagattcgggattcgaaccggtgacttgggacaccataaatctcccaagtggcgactctaaatttcttaatataaataaatcctgtttcgattgttctttaattggaaaaacacccttatataccaccgagtgtaggaaaaaggaggtgtgacagtagagacttgaattttgttcatggcatcgaggtaagtgtttggtctaaccttagcttgagggattaggagtcgagtcttatctactatgtggtatttgttgagtacgacatataggcatggtgacgagtatctttacgttggtgtcaagcatgcccatgagttttatattgtgattattatgacttcgttgtattattcatgctttgataatgatttctattgttgggcaaagtttgtggaagtaattgtgacatttgaacattgaggagcgttggctcaagttgtataataaaatgtgaaagtataaatggtaattgatcccttctagagcattggctcaagtgtgaagtgagttgtgaagtaaaagtgagaaagagaagagaatcattatgtttcctcccttgccgagatactgttgcttttagtgttatctcccttgctgggatgtttatgtttcttttgatgttgataccttgccgggacttgattgttgaactattgttcccttaccgggatttttatcgtaattttatttacttctttgaccttatttcttgtgattgttgtttgggtgaggaagagtgataaagcacgaagggtgatgttgtatatgattttgtgaggaagagtgtaaagcatgaaggataatgccgtgccgcatgatgtaaaattctatgtcgattatattaattcttggtgaggatgagagtaaaagcacgaagggtgatgccgtgcagtttatattggttcttatggtgaggactagagtaaaagcacgtagggtgatgccgtgtacttgtccttgattttcctgattcttgttgataataaagttatgttgtcctttacgtttatttatgaattttctgttgttacttgattttttttatgttatagattcccttaccctatttgctttgtgatttatgcttgggtgaggaagagtgtaaaacatgaagggtgatgccatgtattgttttggtgggagagtgttaaagcacgaagggtgatgccatgtattgttttggtgagagagtgttaaagcacgaagggcgatgccgtgcaattatctttgatttcctgattttatggataactgagttacggtttctctacatttaattgctggtttctattgatacttgttgtaccccgcaacataattcccccttcctactttcaattgaactatagtgatactcatatttatttgttgttcttctgttattagtcgatgtccgcgcagcatgttatccccttcccataattaactgtacattactgttattcttttctgctgtatatgatttaactgcacaggtttaattggtagtctggtactaaccttgtcactacttcgccgaggttaggctaggcacttactagcacatggggtcggttgtactgatactacactctgcactcttttgtgcagatcctagtgctgtagatttcgaaccgcaataagattgctttttcttgttcatcaggtgatctgaagtagtcctgcaggcgtccccgggccttggtgtctccttctatctactatccccatttctttcatgtatttccagagacagtgttgtatttatttctttcatacctttgtttgtagtacccctagacagtttgtgaaattgtgacaccagccttgggtagatttgttatggattggtattggcagtattattaaatttttgcaatgcagtcttcacgagtaggtgccatcatgactcctaagggtgggaaattcgggtcgtgacaagttggtatcagagctctaggttacataggtatcacaattcacagacaagcttagtagagtctgagggattggtatggagacgtctgtacttatcccccaaaggctacaaagttaggaaaagtttcacttccatccttctctgtcatgtgattttgttctctcactgctaatttgaaacctctactcttgtcctttcacgaatggcgaagtcacatacggcttcttcagcagaacagcatcacataccgatgatagatcaactacgtcttcggaggctttgcggaggttggataggtttagattaactacatctttggaggctttgcagagattggatatgtttcaccaagatcttcactactactttcagtggtgcatcttctaaggatccccgagattatctgtgcagttgtcatgaggttctcaggaacatagggatagtagagaccaatggggtcaattttgctacttttcgcttgtctggatccgccaagacttggtggagagattattgtttggctagaccagccgaatcgccagctttgacttaggagcagtttactcagctatttctggagatgtttctccccatcacttagagagagatctatctgaggcagtttgagcttctctagcagggttctataattgttactcagtatgagaccggattcatcgacttggctcgtcatgcttttatcatactttccaccgagagagagagagagagagagagagagagtaaggaggtttattgagggactcgttcagccagctcagtcagctagaggtggaggtaaaggtactagaggtggaggtagaggtattagaggtggaggtagaggtgctagaagtggaggtataggtattagaggtggatgtacaggaactgttctggtttgtagtagagatgcttcggttttatttgatccaggatctacatactcctatgtttcgtcatattttgcaccgtatctagtcatgcctagtgattctttgagtgctcctgtttatgtgtctacaccggtgggtgattctattatggtagatcatgtccatcatttatgtatagttgtgattaggagtcttaagactcgtgtagatttgcttcttttggacatggtcgacttcgatgtcatattagggatggactggttatcaccttatcacgctatcttggactgtcatgccaagactgtgaccttagccttgccgggtttacctcgtttagagtggagagggactcctagtcattctaccagtagtgttatctcatatatgaaggctgacgtatggtcgagaatgtgtgtttggcctatttgtcctatgttcctgattctagtgctaaggttccttctactgattttgtgcccgttgttcgtgagtttcctgaggtattcccttcagacctgtcgggtatgtcgcctgacagggatatggacttttgcattgatttggctctaggaactcagcccatttctatcccgccgtatcgtatggccctgccggagttaaaagagttgaaggagcagttgcaagacttgcttgagaaaggtttcattaaaccgagtgtttcgccttggggtgcaccgatgttgtttgttaagaagaaggatggatcgatgaggatgtgtattgattaccggtagttgaacaaggttacaatcaagaataagtatccattgccgaggattgatgatttgtttgatcagcgtcagggctaccaaggtaatttcgaagattgacttgagatctggctactataagttgaagattagggcatttgatgtccctaagatagctttccgcactcggtacgggtattatgagttcttggtgatgtcattcgggttgacaaataccatagcaacctttatggatttgatgaactgagtgttcacgccttaattggattcatttgtgatactcttcattgatgatttttgatctattccaatagccgggaggagcatgaacaacatgttagagtggttcttcagactatggttacggcttcagttgctaccccacctgctcagtaaactagaggtggaggtcgaggtcgccctagaagggcaggttaggcccgatacaatgcccttcttgcccgtacaaaggttgttgcttctcattctgtcatcacaagtattatactggtttgtcacagagatgcatcgattctattcgatccaggctacacttattcttatgtgtcttcttattttgttctgcatttgggagtatctcgggattctttgagttcccctatttatgtttctactcctgtgggagattctcttgttgtggaccgcatttatcggtcatgtttggttgctcttagtggtttcgagaccagagccgatttattgttgctcaacatggtagatttcgatattatcttgggcatggactggttgtcaccccattatgctattcttgattgtcacaccaaaatcgtgaagctggatgtgccatgtgtactgtgtgttgagtgtaggggtactttagatcacactcccagtagagttatttcttttcttaaagctcagcgtgtggttaagaaggggtgtgatgcgtatttatcttatgtaagagatgtcagtattaataccccttcagttgattcagtcctagtagtacgagattttcccaatgtgtttccagttgatcttccaagcatgccgcctgatagagatattgattttggcattgatctgttgccgggcactcagcccatttctattgccccgtatcgtatggctcctcctaagttgaaggagctgaaggattagttacaggaattgcttgataagggttttattcggcccagtgtatcaccttggggtgctcctatcttgtttgtgaagaaaaaggatggtttgatgcgtatgtgtattgattatcgccagttgaacaaggttatagtgaataaccgttattctttgtctcgtattaatgatctgtttgaccagcttcagggtacacaagtgttttctaagatttatttacgctcaggttaccatcagttgaagatttgagagccagatatcacgaaaactcctttcaggactcggtatggtaactacgagttccttgttatgtcatttgggctgaccaatgccctagtagcctttatgcatttgatgcatagtgtgttctggccgtatcttgactcgttcgtcattgtctttattgatgatattctggtgtattcccggattcggaaagatcatgagtagcacttgaggactgtacttcagactctgagagagaaaaagttatatgctaagttctcgaaatgtgagttttggttggattcagtgccattcttaggccacatggtatcgagtgagggcattcaagtgtatccgaggaaaatagagtccgtgcagagttggcccaaaccatcctcagctacagagattcgcagtttccttggtttggcaggttactactgtcgttttgtggaggtgttttcatcgattgcagccccatgaccaggttgaccaagaagggtgctctgttccaatagacggagtagtgtgaggcgagctttcggaagctcaagcagctttgaccacagccccaattttgatattgcctacaggtttgacgtcttatacggtctattgttatgcctcgagggttggcctaggagcaatatcgatgaagaatgctagggtgattacctacacatccaaacagttgaagatacatgagaagaactaccctgttcacgaccttgagttagctgccatagttcattcctgaacatttggcgccattatttatacggggttccttgtgagatttatactgaccattggagcttgcgacacttgttctagcaaaatgatctaaatttgctctaaaggaggtggttagagttgctgaaggactatgatatcactattttgtatcacccgggcaaggccaatgtagtggctgatgccttaagtcaccggatggagagtttggggagtttgacatatttactagcatcggagaggcatatgacgatggatgttcaggccttagccagctagtttttgatattggacctttcagagcccagtcgggttctagcttgcgtggtttctcggtcttccttatttgatcgtatcagggagcagcagtatgatgacccccatttgcttgtcctcggagacaagggtcagcatggtgatgcaagcgatgtaactattggtgatgatggggtattgaggatgcagggtcggatttgtgtactcaatgttgatgggcttcgagagttgattctagaggaggcccaaagctcatggtattccatccatccgggtgtcatgaagatgtatcaagatttgagacaacactattggtggaggcggataaagaaagatatagttggattcgtagcttggtgtctcaactgtcaacaggtgaagtatgagcaccatataccgagtgggttgcttcagcagatagggattctggagtggaagtgggagtggatcaccatggactttgtatttgggctcccacggactttgaggaagtttgatgctatttgggtgattgtggatcggctgaccaaatccactcatttcattcctgtgcgtactacttactttttggagcggttggcggagatttatatccgggagattgttcgtctgcatggtattcgagtgtccatcattttagatagaggtactcagttcacatcacggttctcgagggtcgttcagtatgagttaggtactcgggtggagttgagtacaacatttcaccctcagacggatggacagtctgagtgcactattcagattcttgaggatatgctccgcgtgtgtgtgattgagtttggagggtcttgggatcagttcttgatattggaagattttgcttacaacaatagttatcggtccagcattcagatggcaccgtattaggctttatatggtaggcagtgtagatctccggtggggtggtttgagtcgggtgaggctagactattgggcccggacatggttaaggttgctttggagaaggttaaggtgattcaggatagactccatacagcccactccagacagaagagttacgcggaccagaaagttcgtgatgtttcctatatggttggagagcgggttctgcttcgtatttcgtctatgaaggtcgttatgagatttgggaagaaaatgaagttaagtctgaggtttattggcccttttgagatattgagacatgtagaggttgcttatgagcttgccttacctcccagcttggcaggagttcacccggtatttcatgtttcgatgctccgggggtatcatggtgattcgtcgcacgtgttggatttcagttcagtcaagttggacaaggatctatcctatgttgaggagctagtggaaatattggacaagtaagttagaaagctgaggtcaaagaacattgcatcagtgaaggttcagtggcggggctagccggtcgaggaggcgacctgggagaccgagcaggatatgcgcagccgttaccctcatcttttcactacttcaggtatgtctctatgctcgtttgaggacgaacgaatgtttaagtgtacgaggatgtgacgagccggccgatcgtcttaagaattaatgccctgatcccctattaactgctttccccaagtttaattatgctattttaattttccgggatgttcggtgttgagtttcggagagttttggtacacttactccctaaatgagagcttaagtgttggaaaattgacgtgttcggtaattttgttagctccgttaagtaatttcgagcttaggggcgtgttcggattgtgttttggaggtccgtagttaaattaggcttgaaatgccaaaaattgaatttttgaagtttcggtccgatagtgagattttgatccgagggtcggaatggaattccgaaagttggagtagtttcgtatgttgaatgtgacatgtgtgcaaaatttcaggtcattcggacgtggtttgatagactttttgatcgaaagcatattttgagaattttggagtttttaggcttgaattcatggttaattcgaggtttcgatgttgttttaaggattggtacaagtttgggtagtgatttgtgacttgttagtcccttttgttgaggtcccggaggcctcaggatgatttcggatggttgacggaaagattttggaatttaagttccagcttcagttgctggttctgtcataaccgcacttgcagtttggtttccgtaggtgcggcgtagcagaagcgtctaacaggccacaaaaaagaaattgacctcccgcagatgcgggagattttctgcataagcggaactgcatctgcgagttggagaccgcaggtgcgaaaattggccattaaatgaaaagtcgtagatgtgaccttggctccgtagaagcgggaccgcagatgcggtcccagggccacaaatgcggaaatcgctgggcagaacatataagttcatgccttcgcgaaatttagccattttttatcttttcaaaagaggaagaatcttggggagcacttttcaagagagattttcagaggagttcattggggtaaggtctttggtccctaaactcgttattggaatgatttttatcaacttaaacatgaaaaattaaggaaaatcagtggtaattgggggtttagggcttgtcaaattggaggcgtttgagtgatgatttaagggaccatttgaagtccgattttgatgtttttggtatgactgaactcgtgagagtccgaggattctagaaatataaattttacccgattccaagacgtgggcccgagggtcattttatataatttcgcatattagcttagaatttaattgtagaatcagttacttgaagtgttatttacattatgcaattgggttaaatagatttgggctattcggagtggagtacccgtggcaagagcgtggtttcgggttaattttgagccggttcgaggtaagtggcttgtctaaccttgtgtgggagaccttccccttaggatatgatatatttgattgaaatgccttgtacatgaggtgacgaatgtgtacttgagctaaatgttgaaaattcggtttttccttaagtatttcaattgagttctttttctgtttttttctacttacgaatttagcatgttgctagtttagaaaagcatgtttagttgacttaattgcctatttgcttaaaatgccttaattgcattacgtgaagcatgttaggctagaataaattgtttacttggtacaaaattctgcttgattgggtattcttgtatagttgtgtattttttattttgggactacggggcggcatcccgggagatcccctgtacgtatttatgatctgaactgaggtgcaggataccaagagatccttggcatgtatattgaggataccaagagatcctcgggataccgagagatccctagcatatattgaggataccaagagatcctcaggataccaagagatctgtagcatttattgtggataccaagagatcctcgggataccaagagattcctagcctatattgaggataccaagagatcctcgggatacaaagagatccccagctatcatccttgttatgagtggtacttcctggtgtttgcctttatttctattatgttattgtactccttgttatcatgtgtagattcttactatagattcttaattgtactatttatcttatcctgtcatcttagtatttatttaacctcaatagggtcctaaccttcctcgccactattcgaccgaggttaggcttggcatttactgagtaccactgtggtgtactcatgccctgtctgtgcatgtttttcatgtgcaaatccaggtaccgctattcaggcctaccatccttaaggaggcgaccgctctagagacttcgaggtacatctgccgtgtccgcgaaccgtgaagtccctttctattcctgcttttagtatttagctcttctgtatttttctgtttttattagacattccggagtttgagctatgtagtattgatcttagcttgtgattcatgggtcttcgggtcttgaattttttttttggtattgagagttgaatatggtgtatgttgagtagcacatttaaatagtgttattactttattactgtttaaagttgttttactttccgcaaattttggttttgttccgcaatttaggcttacctagtcgtagagactaggtgtcgtcatgatggttcacggagggcgaatccaggtcgtgacacgaacgcgaacgcgaaggtcacctaggcctgacccatcgcgaacgcgatacaggcctgcccaatgatttttaaacagtaacagaacactcgggatttcaccaaaatgtcataacttcttcctccaaactccaaattgggcaatttttgtaagataacttcgccacaaattcataggtatgtaatcttagactcattttcttcaatttccattaacacccattagatttctaggcctaaatcatgtttttaagggtagaaaattagggatttgggtagagttagggctttttgtataattggaatttagacctcattttggggtaggatttcaaaactaattacatattcaggctcgtgggtgaatgagtgatcgggttttggtctgaacctcgtgttttgaccaagcagtcctgaggtggatttttgactttttgggaagaatgatgggaaatctataattaaacattggaattgaattgtgtagcatttattgatgttattaagtcgattatgtctagatacaattgatttggagccaaataaaaaatggaaagtggtgtttgaggcttgagttggacgtgttagttcgaggtaagtgtttggtctaaccttaacttgatggattaggagttgtgtcctatttgctacatgttacttgtttagtacgacgtataggcatggtgacgagtatctatacgttggtgtcaagcgtgactgtgagtcttaaattgaaatcgttgttttctaaataaatactatgaatgtctatgtctttgattctttgtgttgaacaaggattatgattatcctcgtggaaattacttatgattgagtatttgtgctggttgaggtagttagatgttggaacaagtttggttatagttgattttcccttgccgggacgtatttacttatactgtcgattcccttattgggatagtgttgtttctttattaatcccttgacgggactcttgttgggaatggtgtcgaactgtatatatggatcgagttgcgcaccgcaacaatattatatttggattgggttgcacaacccaataatattatatttggatcgggttgcatgccgcaacaatgatataattgggtcgggttgcacgctgcaactataatataattggatcaggttgcacaccgcaatagtgataaatgatatggatcgggtttgcacaccacaacagtgttattatgtgttgggattgggttgcccgccacaacaattgataatacgaatgtttatggattcattacgagttctttattgttttgctgtaaattctaaattgcctttatgactttctcttaatttaatgttgatattgatattcccccgcagcatgtaccccctcccatctttacttgtttatttatattttattttccgctgcacattatataactggacaggtttatttagtagtctggtcctagcctcgtctctactttatcggggttaggctagtcacttaccagcatatgcggtcggttgtgctgatactacactttgcactatgtgcagatcctggagtggcaacttttggaccgtagcattgggtggctgccttctgtccagttagagttcgcgaggtagtcctgcatgcgtctgcaggtccgtcgttctcttctatatttctatgtattatgttttcatttacttcagagactgattgtacttttctttccagacatttgtatgtagtatttgtagttggtctgtgaaattgtgacaccagattcctggtagagatgtatgttggtattgtcgtattggtttggctaagttatcagattaagtcttctgcatgtatttatttatcattaatattttactattgatcgcatgttaatttaaattgttaaaagggctaaataaaagggttagtgattctatattacgcggcttgcctagctttcactagtaggcgctatcacgactcccgagggtgggaaatccaggccgtgacaacttagtatcagagctctaggttacataggtctcacaattcacggacaagcttagtagagtctgagggattggtacggagacgtctgtatttatcccctagaggctacagagttaggaaaaacttcacatttattctttcctatcatgcggtttggtttcccaatgctaattgaatttatactcggttattttgcagatggcgagaacacacacttcatcatccaccaatcagtagctcgagcctccaccagtagctcatacgaggggccaaaggcaagggaacgaccatactaggggtcgaggtaggggcaaagctcatcccagagtagcagcaccggcggtggagccttaggttgactttgatgatgaggttccggcccagatcgttctggtggacccagcttaggtcctagatgggtttattgctaccccagcactctaggatgctctggtccatctagtgggccacatggagagtgtcacccgggcagacttgcttcctgtagccccagccgtctctcaggatagaggaggatcctagactccttatactcgcactacggagcagatggctccctagtttcaaactccagcagctcatccagttagagtagttcagccgggtgtggtagcttagaccggtgatggagtagctatgtctgccgatgctttgtggagattggacaagtttaccaagctcttcactactactttcagcggtgcatcttcttaggatccccaagattatctatatagttgtcatgaggttcttaggaatatggggatagtggagaccaatagggtcaactttgctacctttcgcttgtctggatccgccaagacatgatagagagattattgcttggctagaccagtcggatcaccaactttgacttgggagaactttactcagctatttctggagaagtttctccccatcacttagagaaagatctatcggaggcagtctgagcatgtccagcagggttctatgactgttactcagtctgagatcagattcatcgacttggaccgtcatgctcttatcatacttcccaccgagatagagagggtaaaaaggtttattaagggacttattcagccgattcaccttcagatggctaaggagtcaggaagtgagatttctttccaggagccggccaatgtggccaggagagtggagatggttctgtcgcaaggaggtggtcaggggtctgacaagaggcctcgttattcgggcaaatttagtggtgccttgtctggaggcagggattcgtatggtagaggccatcttcctaggcccgttcagtcatcacttcaggtttctcacggcgcttcaggtggccatggttctcatatgcaatattcggatcaacagccctacagtgcaccaccagctcctatcagtacacctccgctccagagttttcagggtggtcattcaggtctctagggtcagtctcagttttcttagccgcaacactcaggtggatgctttgagtgtggtgagtatgttcatatctaaaggtcttgtccgagattggtgggtactcagtcgtagcaacagggttcccgtgctatggttcaggcaccaggtgttccgccgcctgctccgccagctagggatgggggtagaggtgctagaggtggaggtaaaggtgctagaggtagagctcagaccgctagaggtagaggccagccagctgcaggccgtcccagagatgtagtctagggtggtggggcctaagccccgatgttatgctcttctagccaggcttgaggcttccgatgcatttatcacaggtactgttctggtttgtggcagagatgcttcagttttatttgatccagggtctacatactcctatgtgtcatcttattttacaccgtatatggtcatgcctagtgaatccttgagtgtccctgtatatgtgtctacaccgatgggttattctattatggtatatcgagtccatcgctcatgtatagttgtgattgggggtcttgagactcgtgtggatttattactcctggatatggttgattttgatgtcatattgcgaatggaccggttatcaccttaccacactatcttgaactgtcatgccaagactgtgaccttagccttgtcgggtttacctcatttagagtggagagggactccttgtcattctacttttagtgttatctcttatatgaaggcatctcgtatggtcgagaaggggtgtttggcctatttggcatatgttcataattctagtgccgaggttccttatattgattctaggcatgttgttcgtgagttccctaaggtatttccttcagacctaccgggtattccacctgacagggatattgacttctgcattgatttggctacgggcactcagcccatttctatcccgccttatcgtatggccccacctgagttgaaagagttgaagcagcagttgcaagactttcttgaaaaaggtttcatcagacctagtgtttcaccttggggtgcgccgatgttgtttgctaagaagaaggacatatcgatgagaatgtatattgattatcggcagttgaacaaggttacaattaagaataagtatctgttgccgatgttgatacccaatttttccctatatattttccaatatgcaaataccttcaaaatagcatatgtatgcatatataagtatgtccaaatgttttagtattttttccttaatttttaaaggtttttaaatcaatttatttccctattttatccataaaaccccaataattatttctaatattttatttttggtaattcatttattggactttcacatttaggctaaaatatagctaagacaatttttgcatatttttacaaatgtatttagtatttttaaaggctaaattgcataattgcaattttagcctcttttaatatttaattgggtttatattcatgaaaatgaagtcccgtatttttaaattgataataatatgtcatcaatcattttagtacttttaatttatttccagaaatcaatttactatttttttaattttaaataggaaaaagtggctatttaaatcatagcccaatttcatttcaattatagcctgaaattgagcccaaaccagacccaatttcccaacccaattgcaacccgaacccgcccccctaacccaattttaatgaccttactcggactccccacctaatccctttaatcctagttgttgatcatttagatcaacgactcccgttccccctttcctttttaaccccaaacaacccctaaacctatctcatttctcacctactgccgcccttgaatccctcttctctctcaactctctctgaaactcctacaaaccctagccgccgccatcaaaccaaaccctaatccaccctgataccttcctaatccatggccttccgtggtcatttaagacctgtaccagccttccatggctcctatgtgtttggttttatggtttcacgaccagacttcgtaggagtttggtccagtccttgcttgactggtgttcatggcctttctccgaccatccacgacttttcctggcccttcatggcctttcaaggcgggtccttgacattttctggttagatcgttaactttcgagatctttctcgttttcttttgggttttactatctttctcactaaacgtttgttgaaaaccctaacttttgaaaaggtttcctcacttgctactttgagacctttgcatgtttctgatactctgttttcttcactattgaattcaatgtgacttggcctacttgattactatgcttcgaatatttgctttactactgaaccctagcttatttctgccactactacatgcttgtgattatctcttttgccaatgtgcttggcctctcatgtctgatgacccttttcacattatttatatactgaagtgcagaagcatgtttttctttgattgatctcaattgtgtgactgatttcaaaaacttttcttgtatgaactctaatttcactcgcctgttaaagttaattgattcctttccttattttgccttactgaatcttttcccaaaataagcatatttctatacttagacttgattacttactcaatgcttttactactccttatatggaaataatcagtttgtctctaaattgatcttcttttcttattttgaaactgtcattacccattaaacagtgactccttaattaaagggagtcacttctgtaattgattctgactgttgattgtttctgtatttgtattaaaactttacttgttatcttactgcttactcgttttcagaagctataaataccctgcactttctcttctttcaaacacacgaaccacttgagttcagaacacacacttcactcaaagctctctctcttttctctattactacttgtgttgctgccttgtctagccggctgaaagccaaggctaggctgtggaaatttgcttacttttctttctgcatttgcctctttactggtatgttctaattaatcttccagcatcaacaacaacaacatgtttctttactatttccttcactcttgcttgtttcctgctttagtttaatccacttacattaccaagcatgttgtaatcttccccttcctctttcgaattaatgtaatttgtcttatgtatgaactttattagtcattaattatgacttatgaatcccaaacccccatatcccctatgtgtttgtgttctttggttggtttgagggcatgtcagcattagacattgctgtgcatgacccaaacctgaccctccctagggtcatatgcttcatatcccctctatgtattgtgttctctggctggtttatgggcatgccagcaccagctattactgtgcatgtccaaacctgacccctcttagcgtcatacgctccctgcaatgtattcccaaacccctgaccactttgtacaaaaatgctgattctgtgtagtgttagctttactattactattttcaaattacccttacaccttactattctcaatccagttttaaacaaaatctctgctcctgctcttccactatactcttagacttaggtactacacctcttgtatgagccttaccttgggacccatgagctccctctgaacttggactaagggtgttaaaagagccaggtcagcccggttccggaccggcctagaccagttaagaccagaaccggcccagactggtagaagggggctgggttgggctgggttaagggcgactggcgggttgcaccgtttacatttgaaataccagttacccgaaattttaaaactaggcccagatctgaccattggcaatggtccatttcagaaaatggcctttgcccaacggttgaattgcacaaatagcccaattttattttatttttaaattaacccctctttgaaacccctccctccccccctcttcctcatttcttcacgcatctctcaattctcatattctctcattcttcaatcttcattcttcacctattaaagtgcaatcaactatttggctccttttttttggaatttaatttatcgtaatatttattattgaagtttgaacaattgaacttcaaaattggaacaaatgacgtttcttcgtggtaacattggagttgcgaaatcatcaagtgctcaatttattgccgagtttggtgcactccctccaactctttctcatatttactattttatttgcatatttatttgttgctagtagttaaatttttacattatgtgtaatgctcaaaaagagtttgtaacaaggttactaatcggggaaataaataaagagctagtacttcagcttcagcatctggtagtaatttaaatacttctccaaatattcctgaaacattacctgataataatatagattataaacaattgcaggaagtttttggtatagacgataatgaattagaaatggaagatgagataccacttacacctagtagtgttggagctgctagcagggatggtggtcgtggtgctagtagtagaccacctgtggcgccgactagtaatcatatttggaaattttttgaggaaatagaaggtactgatagagttaaatgcaaaaattgtaatgatgcttctaagaataagactagaggacaattaggggggactaggacacttagtagacatatgagaattgagcatcctatagaatagggatctgatggagatggaaatcaatcaactctaaaccctactactggaggtcttgtgaaatatgataaactaaaggatcgtgaggagttagcaaaaatgattgctttggattatctaccttttttcttttgcttattcatcatatcttattatgtatattcaaaagatttacaatcctttatttaaaggtatccctagaagtacttgtagatctgatatctttagactttacggacaatatcaaacatacatatgttatttgtttagccaccttccttgtagagtttctttaacttccgatattggccatgctattaatgaaaatgattatttgacaattacatgtcattgtatagatgatactacttgtatgcataaatgtattatcgcttttaaatatgatgaagatcagagtcatactgttgtgtttataagtagtactatttatgaagttgttgaattttataatctcaagtaaaaagtattgggtatgtcttttgataatgcttctaacattaatgccgcaatttaatataaaaactgcatttgcaaccacctcttgatgaaaagtttcatgttaggtgtgcatgtcatgtttataatttaattgttaaagtggccttgatttattttcaactgagattactcatgttagaagagcagttggtgttattcaaggaaataataggcaatctagaataaaggaatttaagaataagtgtgtccagtataaccttaaacccagattcatgccagacgaaattgttacttgatggaattatatatatttatttttaaaatgttgctacaaatatagattcccaataactgaagttgttaatgcgcattgtactaatccaaaccgtatgttaacaactactacttgggaggtcattaatgatgttgttaaatttttacataaatttatatagctactgttgagttttctagagcatattagcctactaatactatggctttagtacatatttcttttctacactttgaatttaagaagaaagaaaaatatagggacgttgaaaaaatgctagcaagattaaaaaaatatttctttccaattcctccgatttacttaattggtgttgttttaaatctctctattaagatgtctgattgtcaccaattaatgaatgctttatatacttatatggagattggaccaatgaaaccccaaatttatatacttgtatgaacaagctaaataaatatttacaataattatataattattatgcaaatgtagtttatgatgatgctcttaatgttggcaatgttaatcccactatgcactgtaccacttctgctactgtggatgatgaagaatgccttgatagttttaatattttttctacattttctaacactcaaaccagtagcaggaatattgatgaacttcaattctacttccagaagcaaaaagagccttgcacaaaggaattttcaccgttgggatggtggcatgaaaatggaaagcaatttcctgttctttttgctatggctcgggacgtgttgaatgtgccaatttcaactgttgcatcagatagtgcatttagccaagcaagacaacaacttagagacacctgtcactcattgggaagcaatgctttggaagttttagtatatttcagagattggattagatcagaacgaagaaatcaaggacgtgaagatgttgatagcctagaagatgaggaacttggagatatattaatatatggtatcccatccgaatttaacactccagaagaaggtcactcagttcatattgattatgaagaacttactaaggcaatgtaaaaacctttgaatttactctttttggttaatttacctgttgttaaatgtaaaccttttaatttataagtttgaattttgaaataattgtagcacttgcaatttataagtgcaatgtttttccatcttccttgtattctttatattaatacaaaatattaatatatcttacaatatttatacaaaaaaaattttaaaaaaaatactaaacccggcccggcccgaccccctcaacccgtaaccctaacggatcaatttttacccagatgaatctgaacccgttaaacccggtatgccccaacccgtaaccagcccggaccataacccgtatgggtactaaaattcactaactagcccggcccggctcgcctgttaaacacccaaaacttggacacataaatactggtccttccatactacactcatatctatctgggtatgcaaactagggtgtaagcactgcccgaggtcccttgagacccttagggaactttgactcactcaagtctgagaaaggctttggaacaaatgacatttgaggtggtttattccataactcagagaggaagtcaagaatcaggcttcctctggttgtaacttcttcttttacacttttctgttgtaattcattattcagcttgtaataaatattggggttggctagtgaaaaagggctgggtaattgtgcatgcttaagggtagatatcatgcctataagatctgttgtcttaaattctacatgtttaactttgcatttagatatcatgcctataagatcttttattttaaattctacatgtttaactctgcatttagatgtcatgcctataagatttgttgttatgcacttttaactctgcatttaaatatcatgcctataagatctattttctttaaaattctgcatgttctatatctagagaatatgcctataggacctgctttctgcatgtttaactctgcatttagataacctgtctataggacttgtttaaattcttcatgtctaactctacatttagatgacatgcttatagggtttgtcttcaattctgcatatttattaccacacttaggcaccatgctcttaggatctaagtggttacaattcgatatcattaaaattagtaccttttatagaaatcatgcctataggaatttcaattaaatattgcgtgccttatttcatgttcaactagatatcatgtctatagaaattaaaattagcaataatagatatcaatgtctataaaatctaaaaccagtctagtttaaaatcagcctaactcgtattgttctaaattagttttaaacaaccttacttctttattcaatgcggtttagaaagcatgtctatagcatctcaaatcgtttgttgtagaactattcctgctatgctttaaatgaccccactcggactgcccaagtaacccctttaatcccagccgttgatcatttaaatcaacggctctcgttccccctttcctttttaaccccaaacgacccctaaacctatctcatttctcacttaccgccacccttgaatccctcctcctctctcaaatctctctgaaactcctacaaaccatagttgctgccattaaaccaaaccctaatccaccctgatacctacctaatccatggccttccgtggtcatttgagacctgtactagcctttcatggctcctatatgtttggttctatggtttcacgaccagacttcgaaggagtttggtccagtccttgctcgactggtgttcatggcctttctcccgaccatccacgactttcctggccattcatggcctttctaggcgggtccttgacttttctggttagatcattaacttttgagatctttctcattttcttttgggttttctgaaaccctaatctctaagatctttcgatttctttcagatctaccttagatctgtgcttaccatgagcttttaagcgtttttcttgaaggttcttcaacgttgttttcaaaacgactcttcattgttctgaatagggttttcctttaagttatttcaaaaaatcttttctctgattctcgatgttgttttatgactttactatgttcgaactatttattatgctttccttctacttgagtcagcatgttgaaaaccctaatttcttttgggtctcattcgaatcctaaagatgtttgtttaaatgtatacttgtttaattaagttcctcgtccttattggatttatttgtgttacaattttaaaactcgattactgtttaaaagccctaggtctttggggctgaagttgtttgtttaagtacttgactcgactgaaagcttttgtttaagactttcttttctttatgtgactcatctgattatgatttttactatctttctaactcaacttttgtcaaaagccctaacttttcaaaaggtttcctcacctgctactgtgagacctttttatgtttctgatactctgttttcatcactattgaattcaatgtcacttgacctacttgattactatgcttcgaatatttgccttactactgaaccctagcttatttctgcaactactgcatgcttgtgattatctcttttgccaatgtgcttggcctcgcatgtctgatgaccctgttcacattatttatatactaaagtgtagaagcgtgtttcttctttgattgatctcaatcgtgtgactgatttcaaaaaaatttcttttataaactctaatttcactcgcctattaaatttaattgattcctttccttattttgctttactgattcttttcccaaaataagcatatttctgtacttagacatgattacttactcaatgcttttactactcattttatggcaataatcagtttgtctctaaattgatcttttttccttattttgaatctgtcattactcgttaaacagtgactccttaattaaagggagtcacttgtgtaattgattccgacagtttattgtttctatatttgtattaaaattttacttgttaccttattgctcactcgttttcaaaagctataaataccctgcactttctcttctttcaaacacacgaaccacttgagttcagaacacacacttcactcaaagctctctctcttttctctattactacttgtgttgctgccttgtctagccggctgaaagccaaggataggctatggaaatttgcttacttttctttctacatttgcctctttactagtatgttctaattaaccttccagcatcaacaataacatgtttctttactatttccttcactctttcatgtttcctacttgtgtttaatccagttacattaccaagcatgttgtaatctgccccttcctctcctgatttaatgtattttttcttatgtatgaactctgtcagtcatttattatgacttatgaatcccaaaccaccatatcccctatgtgtttgtgttctttggttggtttgagggcatgtcaacatgagacattgctgcgcataacccaaacctgaccattcctagggtcatatgcttcatatcccctctatgtgttgtgttctctggatagtttatgggcatgccaacaccaactattactgtgcatgtccaaacttgacccctcttagggtcatacacttcctgcaatgtattcccaaacccctgacccctttgtacaaaattgttgatactatgtagtgttaggtgtactattactgttttcaaattacccttacacattactattttcaacccagttttaaacaaaatctctgcttctacactaccactatactcttagacttaggttctaccgatcttgtgtgagccttgccttaggacccatgagctccctctaaacctggacacataatggctggcccttcgacactgcactcatcactatctgtgtatgcaaacttgggtataagcactgtccggggtcccttgatacccttagggaactctgacacactctagtctgagaaaagctttggaacaaatggcatttaaggtggtttattccataactcatagagaaagtcaagaatcaggcttcctcttgttgtaacttcttcttttacacttttctggtgtaattcattattcagtttgtaataatttgtaataaacatagggttggctagtgaaaaagggctgggtaattgtgcatgcttaaggatagatatcatgactataagatctgttgtcttaaattctacatgtttaacactacatttagatatcatgcctataagatctgttattttaaattctgcatgtttaactctgcatttagatgtcatgcctataagatctgttgttctgcatgtttaactctgcatttagatatcatacctataagatctatattctttaaaattctgcatgttctacatctagataatatgcctttaggacccattttctgcatgtttaactcagcatttagagaacctgtctataggacttgtttaaattctgcatgtctaactctacatttagataacatgcctatagggtttgtcttcaattctgcatgtctattaccacactagacaccatgctcttaggatctaagtggttacaattcgacatctttaatatcagtaactttatagaaatcatgcctataggaatttcaagtatatactggctgcctcatttcacgttcgactagatatcatgtcaataggaatttaaagtagaaataatagatatcaacgtctataaaatctgaaaccagtctagtttaaaatcagcctaactcgtattgttctgaattagttttaaacagccttactccttttattcaacgcaatttagaaagcatgtctataggatctcaaatcgtttgttgtagaactgttactgctttgctaccttctgaatcagcaatagatatcatgtttttaggatctcacccaaatacttaggtaagccttatccaatagttagaataaaaacctgaaccggcctttgttaatcaataattgctacgaccagcaggccggcctgattcagacttcttatctgagttatgtaataaactagtctgcatcaacaattaaaattctccttgccttagcactttaaattcagaccctaattgtgtttgagtcatgcaatttatgtgctttgtttgaggaggtatacatgagccttttagttgtttacatgtttcccctaatatgcagtcctatatgtttttttgtatgtaaccttagctttttcaccttttgaaacctaaaagtcagcctaatatccctcccctatagaaatagtagtcctaagttcctctgggattgataggagtgggacgggtaatagcatgcaacagtggtcgaggccaatccacgctttaataccttgacagggtgggacaggtagatatggatatgatgatcagtacgctaataccacgtgtatcccctcttttgaggagtgtcataccgggtatcgcattgatgtgatccatataataaataaacctaggacaccctccctttttatattctcaagtatttgtggagttgtaacttcattttcaaaatacgccttttaatagttgcttttcttttcaaattcttatatgtttaaactaaatcccctactatttaagcctatacttgtttatttgctaaattgcacaaattcacaaaaaactgtctggccgggaaccacactagtggatcccgaggggtgcctaacaccttccgcatgggataatttcaagtccttaccctatctttggtcatcaaacaaacttagaagtgaaccttatatgtgtcctaatgcaccttaaatcattaggtggcgattcttcaaatgcaaaactcagttcccaaaaggaatgagttgtcttaaaccctaaatgtcataaacctgattttacgatgcgaagaggaaaaaagggggcacgacaaccgaggaatgatgatttgtttgatcagcttcagggtgccaaggtattttcgaagattgacttgagatttgagtaccgtcagttgaggattagggcatccgatatctctaagacagctttccgcactcggtacgggcattatgaattcttggtaatgtaattcgggttgacaaatgccccagcagcttttacggatttgttgaactgagttttcaggccttatttggattctttcatgatagtcttcattgatgatattttgatctattccacaaccgagaggagcacaagcaacatcttaaagtggttattcagactttgcgggatagttagttgtatgccaagttttcgaagtgtgagttttggttaagttcggttgcattattgggtcatgttgtatcagcggagggtattcaggttgatccgaagaagatataggtagttaagaactggcctagacccacatcagctacagatattcgaagtttcttggggttggcaggttactatcgtcggtttgtgaaggggttttcgtctattgcagcctcgatgaccaggttgacctagaagggtgcccagttcaggtggtcggacgagtgtgaggcgagctttcaaaagctcaagacagctttgaccatggcaccaatgttggttttgcccacatcttcagggccttacacagtttattgtgatgcatctcgtattaaacttggtgtggtgttgatgcaggatggcaaggtcattgcctatgattcgcgacagttgaagattcataagaagaactatctggttcatgatttggagttggtagccattattcacgcgttgaagatttggaggcattatttgtatggtctggcatgtgaggtgttcacggatcacaaaagtctgccatacttgttcaagaagatggagttgaatttgaggcagagaaggtggttggagttgttaaaagactatgatatcaccctcttatatcatccggaaaaagccaatgtggtggtcgatgctttgagtaggatgtcagctagtatggcagtcctgcttatattccagtcggtgagaggccgcttgctttggatgttcgggctttggccaatcagttcatgagtttggatatttctgagcctagtcacgtgttagcttgcacgatcgctcattcatctttattggagcgtatccgagatcagcaatatgatgatccctatttgtgtatccttagagacacggtgcatcacagaggaaccaagcaggttaccttaggagatgatggagttttgagattgaagggtcgagtttgtgtgcctaatgtggatggactccgggagttgattttaggggagggccatagttcccggtactctattcatccgggcgctgctaagatttatcaagatttgcggcagcattattggtggcggaggatgaagaaggacattgttgcttatgtggctcggtgtttaaacttccagcatgttaagtacgagcattagagacctggtggtttgttccaaaaaattgagattcctaagtggaagtgggagcatatcactatggacttcgttgttgtactcccacgaactcagaggaagttcgatgtagtgtgggttattgttgataggatgaccagttagcacatttcattcctgtggcagtttcctactcttcggagaggttagctgatatctatatccaggagattgtttgtcttcatggtgtgcccgagtctatcattttggaacgaggtatgtagtttatctccactttatcgagagcagtttagcgagagttgggcacacaggttgagttgagcataacgtttcatccttagacggacgagtagtccgagcggactattcagattttggaggatatgctccgagcttgtgtcattgacttttgaggctcgtgggatcaatttttgcttctagcagagttttcccataacaacaactaccagttgagtatccagatggttccttatgagacattgtatggtaggcggtatcggtcaacgattggatggtttgagccgagggaggctcggttgtttgatacggatctggtttagggtgccttagacaaggtcaagattattcaggatagacttcgtacagcagtccaagaaaaagagttatgccgaccgtaagattcgatatttggcattcatggtcgtgtctcgtctatgaagggcgtaatgagatttgaatagaagggcaagcttagccctaggttcatcggctcgtttgagattcttgatcgagtggcagaggtggcttacagacttacgttgccgccgagcttattagttgtgcatctagtgtttcatgtgtccatgcttcggaagtatcatggtgatccatcccacgtgttagatttcagcattgtccagttggacaaggacttgtcttatgaggaggagccgatagttattctagaccagcaggttcgtcagttgagatcgaagacctttccttctgttcgtgttcagtggagaggtcagcctgctgaggcattgacctaggagtcatagtccgatatgcggagccgttatccccatcttttccccgactcaagtacttactttttatgtatgtccgaggacgaatggttgttttagaggtggagaatgtgatgacccaaaagttcatcacttgagttaaaatgaattttgcatttcgaggccttaaaaacctctttcagcaccaccttcatttgtgtgcgcagtccgggcacgtagccagaaagccattatgtgtactctaagaaaaatgatgaattttgactttaaaatgaatttaagttgattttggttaacattttgggtaaacagacccggacacgtgatttgacgatcccagagggtcggtaggaaaataagggacttgggcgtatgcccgggatcgaattccaatgtcccaagcccgagaaaagcatttttaaagataattattttctcgaattgtgatgaccgtcatcacttgttttaaaagaaaattctgcgttctgaggccttaaaacctcttttagcatcaccttgatttgcatgcgcagtccggtgcatagccggaaagctattatgtgaaaatctgtgaaaaatgataaattttgactatacaatgaattatcttgacttcagtcaacattttgggaatatagacccggacccgtagtttgacggtcccgtagggtccgtaggaaaatatgggacttgggcgtatgcctgaaatcggattccgaggtcccaagtccgagaaatgaatttttaaaagaaattattttctaaaaaatataaaggttttgaatgtgaaatattatgtgaaacttgtggtatcgggcccgtattatggctctgaagcccggtataggttcaatatgatttatatgtgttgtcggtgaagtttggtaagaaacggaatccatttgacgtgatttggaccttaaatgcaaaatttgatgtttaaagaagttttgagaaatttcattgattttgatgtgtaattcgatgttcatgatgttattttcttgattttattacacggataaatccgtaggatgtttttgaggttgtgtgtatatttgatttggatccccgacggctcaggtgacttttggataggtcacagagtgtattttggacttggaaatattgcaggtttcagctgttgtgcataggtctgcaggtttcacaaatgcaaaccatggcttgcaaatgcgagacctccaacgcaaatgcgaaaagaggacctgggcaggccttatcgcaaatgcgaccacttggctcgcaaatgtggaaggcccagtcgcaaatgcgaagttctcctttggtgcctgaggtcgcaaatgcagcccaacctttgcatttcccatctcacaattgcaatattcctttcgcatttcccaacttagcagaggtcagggtttgcaattcccatatctgcgacctgcaacttttatacttagacgaatttttaacccattttcatatcctctcaaaacataaacactatagggagatttttgaaaggcttcttcttccaaatcaattgtaagtcgtttttaactagttttcttcaatccttaacatcttctaacatgatttcaactcaaaatcaatgatatttgtgggggaaattgggtgttttgggtagaacctatgttttttcaaaaaatggggattcggacctcgatttgagatctaatttcaagaaaattatatttttgggtttgtgggggaatgggtaatcggggtttggttcgaacctcgggttttgaccatgcggacccgggggcgatttttgactttttgggtaaaactttggaaaatgcattttcatgcattggggttgattcatttagcgtttattgatgtaattaagtaacttgtggctagattcgagcgaattggtggtataatcaaggggtaaagctataattgaaacgtgaattgtgttcgtggtatcgaggtaagtgtttggtctaaccttagcttgagggattaggagtcgtgtcttatttgttacgtgttaattgtggagtacgatatataggcatggtgacgagtatctatacgtcggtgtcaagcatgcctgtgagtcttgtattataattgttatgactccgttgtggtttattacgcttcacatgttattattatcattgttcccttgccgggatatttgtttgatatcattgttcccttgctgggatgtttgtttgatattattgttcccttgccgggatgttgttgaaatattattgtcccttgccgggatgttgtcgaaatattaatgttcccttgcggggaagtcgttatattgctcttgtttccttgccgggattctttgtgattgttgttgatttgtaactgggatctggtgttacgccttccacaagataaatgaaatgggagcgggtggcacgcctgccacaagataaatgaaatgggagcaggtggtacccttgccacaagataaccaaaataggagtgggtggcacgcttgccacaagataaatgaaatgggagcgggtggtattcctgccacaagataaatgaaatgggagtgggtggattgcctgccacaagataactaaaatgggagcggatggcacgtctgccataagataaatgaaatgggagtgggtggcacgcctgccacgagatacatgaaatgggagcaggtggcacacctgccacaagataactgaaatgggagcaggtggcacgcctgccacaagataaataaaatggaagcgggtggcacgcctgccacaagataaatgaaatgggagctggtggcacgcctgccacgaaataaatgaaatgggaggaggtggcacgcctgccacgagatacataaaatgggagcaggtggcacgcctgccatgagatacatgaaataggatcgggttgcacgccttcaacaagatgtggaatgaaagtgaaatctgcctttgttttccttatccttgttagtagttggttttttggttactttataattctcttgatattctacttttacttgttattccccgaagcatgttttcccccccttatctttacttgtttatttttgctttactttccactgtatattatataactacccatgattatttggtaatctggtcctagcatcgtcactacttcgccgaggttaggctatgcacttaccagcacatgggatcggttgtgctaatactacactatgcactatgtgcagacctcggagtagctcttggaccgtggttggagggtacctttagtccacgcaggtatccaaggtagacctgcagtcgtccgcaggctctgacgtctcctctatcttttatttcctgtttcatcttttgcttcagaaacactgtgtattttactctcagaccatgtatttagcagtcttagacggtctgtggtactatgacaccaggttttgggtgattaaggcttccgtagttgtaatagatacagatttaagatattttattatttccttccgcttaatttaaatttcagttgtttatgcgttatcgcttatgtttgtaaaaaaaagaaataaatgggtaatgaagtaattagtttaaaggattggctttcctagctcacactagtaggtgccatcacgactcccaagtgtgaaaaatctaggtcgtgacaagttggtctcagagctctaggttacatgggtctcacaattcacaaacaagcttagtagagtctgagtgatcggtacggagacgtctgcatttatcacccagaggctacaaagttaggaaaaaacttcacatttattctttcctatcgtgcagtttggcttctcaatgctaattgaatttctactctgttctttcgcaaatggcgagaacatgcgcttcctcatccagtgaccagcagcccgagaccccagcaacaactcccacgatgggaagagggcgaggctgaggccgggctagaggctgaggtaggggcatagctcagccccgagcagcaacaccaacatcggagcctcaggttaattttgatgatgaggttccagccctagcagttccggtgggtccagcccatgtcctagaggggtttattgctacccagtacttcaggatgctttggttcgtctagtgggccttatggagagtatcgcctaggcaggcttgcttcctgtagcaccacccatctctcaggatggaggaggagcccaaactcttgctactcgcactccagagcaggtagctccccagtttcaaactccagtagttcagccagttggagcagttcaaccgggtttggtatctcagaccgatgatagagcagcgatgtttgccgatactttgtgaaagttggacaggttcaccaagctcttcactactacattcagtggtgcatcttctgaggatacccaagattttctagaaagatgtcatgaggttcttaggaacatggggatagttgagaccaatggggtcgattttgctacttttcgcttgtctggatctaccaagacttggtggagagattactgtttggctagactagccggatcaccagctttgacttgggagcaatttactcagctatttctgtagaagtttctccccattacttatagagaggtctatcggagacaatttgagcatctccagcagggttccatgactgttacccagtataagaccagattcatcgacctagctcttcatgctcttgtcatacttcccactgagagagagagagagagggtgaggaggttcattaatggacttattcagccgattcgtcttcagatggctattgcgactgggagtgagatatctttcccgggagcggccaatgtggccaggaaagtggagatggttttgtcgtagggaggtggtcaggggtctgacaagaggcctcgtcattcaggctgattcagtggtaactcatctggaggtagggattcgtatggtagaggccatcctcctaggccttttcagtcagcacttcaggtttctcacggtacttcaggtggctttgtcctcagatgtagtattttgatcaacagtcctatattgcaccaccagctcctatcagtgcaccaccacttcatagtttccagggttgtcagccttagcagccgagggcttgttttacttgtggcgacatgaggcacattgctagttattgccttctagcatcgagcacctcagcatcagggttctcgttccatagtttaggcactgagtggtccgcaacctgcccaaccatctagaggtgggggtagaggtgctagaggtggaggtagaggtattataggttgagctcaggctgcttgaggtggaggccagccaacaacagtccgtcctagagatgtagttcagagtggggggcctagccccgatgttatgctcttctagctaggcccgaggctgagactttcgatgtagttatcacaggtatgatttttgtttgtgatagatgtcatacctcctttttcactacacctcgtaaagggtataaatacaaaggagtttttccaattaaaggacaatcgaaacgggatgtgtttgtttaaagattcagagtcgccacttgggataatttatggtgtctcaagtcaccgatattgaaacccaaatcgaggaaaaattgactctatttgacagtccgcgaaccagaaatccgattaaggaattctattaacccgggagaaggtgttaggcattcccgagttccgtggttctagcacggtcgctcatctattataatcggattaactatctgattttaatcaattatgaacctatgtgccgattttcactttttaacctcttttaattaatttttaaagaagattgcacgtcgtttaaaacatgtctttggatcttgacacatgaaatgcatccgcaatcctaaacatattttattcaatgttttaagacttgatttgggtcacatgaaatgcacacccgagttttaggaaggtaaattattaaaattgcgtgcctaaagcaactacgcgttttaactttgcgagggccatggaaaatttgctaaatggtgcgcttcgattctaatttcaaaggatgtttggactactcttttgagggccataaaatgtatgtttggttaatatagcacacctcaactatttaatgagcgtaattaattgattaaaagatataaatgaatttctacttattataagccactgttttagttaaactttaataactaatgagctagtaatagacaaaaccaatggttgattgttgaaaggcctagtctggccgtaagcccaacgactggccgcccattactgcatgcccagcacgagagacaactgggctcactcatgaagcccagactgataatctaattgcagaaggggaaattgatcacaactgggccaacgatggcagcccaatttcaagatttaaaactaatatttgaagtaaactacattcttatggagatttagagtttgaacaaacaccaacaaccttgagccaatgcaaaacacattcttgatgctaacacacttgctgaaatgaagttatagttcctgattatcaacaactcatatgtatgtcgtttcatcattgaaagtcactaattcaaatttccagcaagaagaaaacaatttaaagtttcaaaaagacttcatttattaacaatggacttggaattgcctaactctaaaccttgaaaaaaaagcaaacacaagctgatttcacctaaatcaaataagagattttcctgtattgcaacataacacacttcatgttcaaagaacaaccaatcttatgcatcttaaagttagaacttctactaagaacattgaaactaaacagtggcttcaatagagtaatacagccattcgaatcagctatcaaaatacaataacatgcaatgaatttgtttaaatgcctaaaccaaaatctggaagaggtaaataaccacaagttaattaacaaaactacatgattacagaaccaaataatcaaaaatagactaccgtaaaacatggtttcatcaacattctcatttccatttcaacatgtcatttgaggtcgaatgagtacctggttacagcaaagataaacaaagagctttgagaatcagcttaaagcaacaccaaggtagcaggcatagcagcagaggtcagcagtaaaaccaaatcaaacagtttccaaaaatccagcaatttcacctctttaaacaatttttaccttgataaaaccaaagttatttgaagcttttttaaattccagctgaaacccaagattagggagcagattcagatctaattcctaccccaaaagatgcagaaatttcaatgtattttcagaataacttctctcagtcgtttttgcttttcagtatttttggagtgttaaaaagctgcccggaaatgaagggaaagagatcatatataggcatgcctaaggaagacctagtacagttgaccaattccctctctaccccttctttcttagttgtttttaccctttttaaccttttagaaaaaatatctgaaaccctcagctctcatataatcctctagaaccttctatgctaacagaaaatgattccctcaaacctcaaatccctaaattaacccttgacccatgtattaccctcaggcaaccaaaattgggtcaagttatcccaagacccagcccaaacccatgggtatgtatactacagcccaaacttacaacttcagaccatcaattaaagagcattgaagctcaaatgatctgggatgttcaggacaaacgaaagaaaaatgcagggagggaaaagaaatgagtctcagagaactcaaatgatttaaaccaaaaagaaagagaaaaaaatatttaatcaatttagcaataattcgaaccttataaaccaaaatcgggtaaagccaaacaaatgaatcaagcaaaataaatattaaacaggcgacttaagagcatttaatcacaattatattctcaatgaactatgttaacgagaattcaaccgaaataagaaaaaaaatgatataaagaaggagaaacacatactaaagctatcagagacaggcatcatttaacaaacttgctggtttttggtcttgcatgaggccgatgagattcaaaacgaatcgaagtctatgctagtcactcgttctcaaggagaaaatttgggtggcataaacttcgaaccattatcggcccagaaatgcttgaactctgacatggggagcaagattagggtttatagaactttggtctttgatatgagatttgacgatctaggctatgattcgaaggtaacgggctagagatttgggatgaggggacgaagggggttccaaggtgttattttggggtcggaccgaggtggcactgccaccggagaacataagggcggcgctagggttttctttcaatctaagattcgagacatcctgggcttgttcgatggaaggtgctcgtagatttggactgagggagttgaggagggtatatggtgttaatttgggtggtgtttggaggtggcactgccaccggaggccggggatttgggggcggcttatctagggtttcggggtgtttgtggtgaaagtggtgagccgaagggattcttagggggggagaagggttttcggacagttaaatatccctggcgcttcagttctgagccgtttgatcaatgggagatcaacggctcagattgatacttattaaaacgacgtcgtttagtttgggggggggggaaaccgaccggatcaaggcgtaggtttgggccgggtattgggtaatttcgtttgggctggggacaattaaatgggttttagcccacatttggattttctttcacttctttcttttcttttttcaacttcaaaattcttttctttgcaaaattaaaataaaacctaaattaattaataataatttttaaactaaattaacctatccaattagattaatcactcatcatggtatttataataattaattaaatcctaaattaaaataaaaattatacaattgaaaattaaaacgtaaaaatgcaaaatgaattatttttttgtgattttcattttttataaacaaactaatttactaattaatctaaaaatataaaattaaatcctaaatgcagatgcaacatatgtttttttttcaagaattaaataaattaaacatgcacaggcaaatgcaaataattaacagataatgccacgaaatccaacaaaattgcaaacactgaaagaaattattttattttgaatttgttggagtaatacatataaggaaaaaatcacgtgatcacagctgcccctctttgcccggaaatacgaagagtttttgtgcaaagataagtgagcgaatacgagcgatttttgcccgtttgaatactccgcaggaagcattttttgaaagatttgaccgcaccctgcttccgaggtttcctacatatccttggctaaaagggaatcaggtcagtgtagttcgggaatgtctgttagttgggactaccatagagctgtgatttcactgttgctgtggctgctgctgctcactgaacacctcattacaccatgtcaaaaataaaagaagctaaactagactatgatctatgctttacaaaatcctatatagatattcaaacttgatcttgtgtctcttgttgccttattcccttgtattctctcggtaaaattccttcattgccgccttgaattgtaaattgagatgtttccctttctccaggtagatgtctgactgctgaactcgatgtgtaatcccatgctatccaggtgggttcctgacttcgaaacatgaatatattcccatgctatccaggcggactcctgacttcaaaacatgagtgtattcccatgctatctaggcgggctcctgactgctaaactcgaaagtattccctgctttccaggcgggctcctgacttcaacttgaaagtactccctgctctccaggcgggcttctgacttcaaaataaacatagcaaagaatttgaaagctaaaacgtaaatggtactcccttgttctccaggcgggctcctaactgctacgcttgaaagtatttcttgatctccaggcggtttcctgacttcaaattgaaatgcattcactgctctttaggcgggcttctgactgctgcatttgaaactatttcctactctccaggcgggcttctgacttcaacaaaatagacaaaacaaagaaacttttctaccccagttggtggttgggcacaggtgtaagtgttaaactgaatcatattacccaatattactaagaatttgaaagctaggtcctattatgcaagggggtcttgacaactcttaactaaacgacaattttaaatctaagttatatcttctacaggtgtgacttctgctaaatcttgctatctaagagaatctttaaactactactcattatctaggagggtcctgaaatcaaaagtcaagttttatcataagagtgacaactttcatggctgaattatactaccctacagcagaacctacgctaaatgttattgtccaatcgaaatcttaaagctaagttccattattcagtagggtcctggaaacgcctaactgaatcctatctcgaacaagcaaacttctaagccaacttatatcaccttgggatacatttatgctagattatactatttctgaactttaaactaggtcctattttccaggagggtcctgaaagtttacgggcaaacctgttttgatgcttgctctttcccctgcggagagtttctccgaaacaaacgaattatctgcccatgtttcaatcaaagaaaatttggtcagtttaaaatggtggttagctgatggcattctttttggagatctttccactgcattgttttgttccgaatggctttcccgaactggccttgaaccgctttgactttccgactgactttcaaatcccatggtctttgatgaaccgagtgttctatacccgtgttgttgtttcacacctctgaccccttaatctgaacctttgcatctcccatgacattactaaatcattccaccgatgaaacttccggtgattccttgtaccccaccctacatcatgttgtctttagtatgctctgaccacattgtgatttgcaattttgggagttggtagtgagctttgaaacttttttccacttacttgggacaacactgacattaaaacctcttagaaaaataaactcaaaagaaaatgaaatgtaatgactttacgggttaagtataagaagaatccaaaaccagataacttctacaaagggaaaaagaaaaagaaacttatctgagtggaccagctggtacaaatgatcatgacatgcatttcggattaattggcccaatctgtccaaccaatcaactttcagttgccgtactttgtcgcctcagaatttccatgacctgattactttacccaaaccttgaccttgttcatcctgcactgccttgaaacagttttccaccaacagtcctttctcacttgttgacttttcaactaactttcaccaaggtgcccgtgagggttttcaccaataagactctctcattttatttctctcaactctcgtcgccttatggtgcttgtgaaggttttcactaataagactctctcatttatttttcctgcttgaaccagagtgttgcccctgacatgaattacctttacctgctcgacttggcatttctcaaagactgatcagaaggtctttctttggaccgtaatgtgggattttggacaaggttagaaagaaaaggcataaaaggctcaaaataattcaaatgggttaaaattacaactttcagaatcagacttctcataacgaccacgacttttgccccagttttcttccttggggacttttgaatttttattttgatgagaccgaaccgtgaggctacctatgtatccttaaaagaaatcaggtcgaatgtagttcatgtcatagaaattacttgttgtgattttctcttttctctttcttttctttctctttttttgctttctttttctctttttgttgtttttcttcttttcttttttttttcttttcattcttttctttctgttttttcttttattatcttttttttcatttcatttttcttctctcccttttcattcttttcttttctccttttcctttacttatcttttacacttctgtttctgatcttttctactaattccgaaagaggggtaagaaaaaaaataaataaggctcaaaaggggtgacgagggatcaagtgtttagatagcagaacaaaacgcctttgctatttcaatcttcaaaatatgccaaatacaaacaagtacaatcaaacaaaaaaatcatacatagtatctcttgactgcatcggaattgatagccattttcacacatttcccttctacatctgtcaaatataacgcgccattgaacaacactctagttacgacaaatggcccctgacccacttcgaacttccgtggatgtaccttcttgttatatgctctcgccattctctattggtacaattggccgtgacatactgctgccaatctctttttatcaatcagacttaattactccagtcgggttttgacccattcaacgtcatcaatttctgcctcaacgacaatccgaagggatgggatttcaatttctgcgggtattactgcctccatgcaatacaccaacaaataaggagtggcccctactaaagtgcgaacagtagtgtgataacccaacaatgtgaaaggtaacttctcatgccactatctagaaccttccaccattttttgaagtatcttctttatattcttgttggctgcctcgactgctcaatttgccttagggcggtattaggtggaattgcgatgtataatcttaaactgctgacatgtctctgtcatcagatgactgttgagattagtgccattgtccgtgatgataaccttcggaatcccaaaccgacagatgatatttgaatgcacaaaatagactactgctttcttggtcacagatttgaaagttttcgcttctacccacttggtaaaataatcaacggctaccagaataaacttgtgtccatttgatgctgctagctcgattgtcccaatgacatccatgccccaagcaacaaagggccatggtgccgacattgtatgcaattcagatggcggggaatgaatcaaatcttcgtgcacctggcattgatggcacttgcgcacaaaactaatgcaatctcgctccatagtgagccagtaataacctgctcggagaatcttctttgccagaacgtacccactcatatgtggtccacaaactctagagtgtacctcagtcatgataactgtggcctgtttggcatctatgcatttgagcaatcccaaatctggagtttttttttatacaatacacctccactgaagaaaaatccacttgccaatcgtcgaattgttcttttctgatcacctatatcctgtaccggatatacccccatcctgaggtactctttgatatcatggaaccatggatccccatcaagttctttttccaccatattacagtaaacatgttgatcacggacctgaatctacaaagggtccacataagccttatctggatgatgtaacattgacgccagagtagccaaagcatcagcgacttcattatgtattcttgggatatgcctgaattctattgattgaaaccgttgatagagatcatgcaaacattgtctgtatggtatgagtgtcaaatcccgtgtttcccattctcccggaatttggtgcaccaggaggtccgagtcacccaagaccaagacttcctagacacccatatccacagctaacctcaaacctagaatacatgcctcgtactcagccatgttgttggtacagtaaaaacaaagctgagccgtaacagggtagtgcttccctgtttcagcaataagtactgctcctatccccacgcccttcatgtttgcagccccatcaaagaaaagtttccatcccgacttctcaacttgctccaactcatcaatgtacatcacctcttcatcggggaaataagtttccaaaggttcataatcttcatcaaccgggttctcggccaaatggtccgccaagtcctgtgcctttattgcagttcgattcacatagacaatatcaaactctgtgagcaggatatgccactttgcaagcctccctgtgcgcataggcttctgaaagatatattttaatggatccaagcaagatatgagttaagtagtatacgatgacaaataatgtttcagcttctgtgccacccaggttagggcgcaacatgtcctttcaagatgagtatacttaacctcgtatgacgtgaattttttgctgaggtaatagatggcctgctccttcctgccagtgatatcatgttcacccaatacacaaccgaatgaattgtccaaaactgtcaaatatagaatcaaaagtcgccctggttttggcgggaccaacatgggtggatttgacaaatacccatttaacttatcaaatgcctcctgacattcatctatccatttgaccgcatcgtctttctttaatagcttgaagattggctcgcatgttgtcgtgagctaagcgatgaacctgctgatataattcaatctccccaacaaactaatcacctcggtcttgttcctcggaggtggcaattcctggatggccttgactttcgatggatccaattcgatgccccggcggctgactacgaaccccaacaactttctatacggcaccccaaatgcacactttacaagattaagcttgagattgtacctacgaagccttcgcaagaacttcttcagatccctgacatggtcagactgctttctagacttcacgatcacatcatccaagtacacctcaatttcctggtgtatcatatcatggaatattgatgtcaatgccctcatgtaggtttccctagcatttttcaagctaaatggcatgacccgatagcagtatgtttcccacggcatgatgaatgccatcttttttgcatcttcctcatccattaagatctgatgataacccgtgtaacaatccacaaaacaaccaatctcatgtttggcacaattatcgatcaagatatggatattcagtaatgggaaattttcttttgaactcgccttgttgagatcccgatagtcaacacacaccctggtcttgccatacttctttggtagaggcacaacattggctaaccaggtgggatactggggtgacccgaatgactttggcatcgaactgcttggtgacctcttccttgatctttacactcatatctgttttgaactttctcagcttctgtttgacaggagggaatgccaggtcagtgggcaacttgtgaaccactaaattagtgctcagactcagcatgtcatcgtaggactatgcaaaaacatctttgtattcgaatagtgctttaattatctcctccttgagtagaggttcaagatatacacttattgtagtttcatagacattatcttggtcccctagattaactgcttctgtatcgttcaaattaggtttgggattttcctcaaaatgacttagttccttactaatttcttcataggcctcattatcatcaaattccaactcgttatcacactcaatttcttgtattattatttcagagttagattggcttttgaaactaggccgaagattcctcatgcatgtcatgtcattaataccaacataaaaagaactgtacaatagaagaaaacaaaaataaaattagaagaagtgaagggaaaggaacaattgcactttattgaatataaagataacagggttttaacacatccaactagatggaacataatatctgaattacagaccctggaataatctagacaactaaaagaaaatcaaaaccaactaccaagactccctccgggtaggaagatgagtagcttcccagttgttgacttttgcacgtggtcccacaaattgcacatctgccctgctggacccttccccagcctgaaccatgttaacctcggcaaataacctttcgaaccccttctccaagtctccatcggcaccaatcagtgatccaggaacctttgacagctgttgctttctgatacccggcatgacgaatgatctagacagacgtgggattggctttggcaatgcccatgctttctgtttcatttttctagatcttctcacatctgcaacggtagtcttgaaccgcagaccaaaagtatccagattctttggaagagaaactggttgcacaataccttgtagagttgcacccaaacccttgcccggtatgaaaccatttttcaacatttcaacagctaccatgactgatgcagtatccatcttaggagttggagctcactttccttccggaattttctctaccgatactgtgtcgaaaacttgataaacccatggtcccttgccatcatcaacctctacgaacggaacaatggcagcattgggcacacacaagttatcttcaccatgtacaacaatttcttgtcgatctcattcaaacttgaccatttgatgcagagtagacgggactgctttggcagcatggatccagggtcatcccaacagtagattgtacgaaatagccacatcgagcacttggaattccatggtaaattcaactagccctattgtgagctcaagcactatgtccccgactgaatctttccctccactgttgaatccccgaatgcaaattttgttcttgtgaattctttcatcctccactttcagcttggtcaatgtggagagaggacaaatgtttgcgctagacccattgtcaaccagtacccgagtaaccatgaaatcttcgcatttcactgtcagatagagggctctattgtgctcggtaccctccacgggaaactcatcatcagaaaaagtgactttgtttacctcaaatatcttagtagctatcttttccaagtggtttaatgagattttgtcaaggacatgggcttcgttcaagatctccatcaaagcccgacggtgttcgtctgaatagatcaataatgacaagagcgagatctgagttggtgtcttccttaactgctccacaatggaatagtcttgcactttcatctttctcagaaattcctcttcttcttcctcaatcaccgttttcttcaccaatactggattatcttttgaggtcttagcttttctcaactcttcgggggcgaagcatctccccgatcgagtcaaaccatgagtctcacacacttcttctctaacctatttccccttgtaagtcactgtcactcattcataattccatgggattgccttgctgctaactattagtaattgggttactggtttgataatgataggacctgtggggagcccttcacaattaccacaggtttattcatcactcctagcacaaccacttttgctttttcatgttttcctgcaacgtcacttgaggaccccttcttgacctccatagatggttcattatttgccctgttcaacttgatcatagacttcttactggttgacttttcaaatggcctggcttcactagccgaatcatcatgacggtttgcgaaggctttttaggctcccctcccctatgcactatctcaatcatatttgtttcatgattggctggcaagggattctgattgatattgggcgcctccggagcttggacctcaatccgattggtgtcaatgagttcttgaatggttgttttcaatttccagcatttcattgtgtcatgtcccggggccactgaacaatacttacaactcaccgagtggtcaagatttttgggatggggattcgacaatttaacctcgatcggattaaacatacccaactatctcagtctgtggaatagactagcatatgattctcccaatggagtgaaagtcttttgcttctgcaacctctcattattaaattcttgtttgggtcaaaaacccgttccaggaggatttctgtaggcctttgggggtggatagttattttgtggagcttggtatgggttttgtggagctagcgcatgccattgtgagtgagcgggcggctgggtataggtttgttcatgatggacagaaaaatagggatctagcggcgggtaatagtgttgtggtgggttatatgaagtgtgggggtaagtttggggatagggtcgcggttggttgtagtaacggggaaggttcctggatctgacccaagctcccgactcaattgttgcaacatcctcctccttcttcttcccgagcactcccccagtaccgttttaaatggcctgagtggttgccatgattgctgaataactcatgatcttgttggacttgagtccctctttgaccatgcctcccattttcactacttcattaaaggaattacctacaacagacaccaagtgaccaaaatacgtgggttccaaagcctgtaggaaatattcaaccatctcgctttcattcatcggagtgttaaccctcgctgcttgctctctccaaaggaatccatattccctgacgctctcaccgggcttcttcttaagatttgtcaacgacagacgatctgggataatttcgaggttgaactgaaaatggtaggtgaaggcttgggccaaattgtcccatgtgtaccacctaatgtgatcttgtctggtataccactctaaagtcgatccactaaaactttggctgaaatatgccatcaacaattcatctcttccacctgctcctctcatcttgctatagaatccttttaagtgtgctaccgggtcaccatgcccattgtatagatcaaacttgggcattttgaaccccactggcaactgaacatctgggaacagacattaatccttgtaggccacacttacttgacctcccaaccttctcatatctcggaatgactattctatgcttttgacctttctgatcatctcttcatgctcgggatttttgggtggcttctcgatctctacccggagatcaagatgaggggtgtaaggatatgattctggaactttgaaggtgggttaagggggatagtactggttgtcgtgagtttggaacaggggttcactggaagatcggtgtaacatagcaggtggaggtaccacaaaaataggtgcgatttgtgggggagggtatgggacttgtttgggtggtggaacttgagaagtatgggaagtggcgccatggcattgttagtagaggggaaaggctggagatgagttcacagtgggaggctctgtgagttaggctgatggtgggatataagtagggttggcgggataaaccggtggtggatgccctttcgcccatgcttggtacatttcagccatctgctgcttcagcttatacatttcttcgctcattgcattaacgtccaattcttccacttcttccgatgggtcgacagtgcttgtttccggttcctggttggccatattcagcctgtctttcgatcgggtgttgtatgagtgagttgccagaatgccagtcaactaaccacctgcctggacttaatacatcaaacaacaaccttgttagcgattaggctttaacagattggcaaccacacattgggcatgaatgcacctaaacagttaaccgtctctattatgtatttgatcggttgcatgcatcatcccgatcttttctttctttttaattgcaaacttccccctttttctttcttttttgttcccttcctttcaatctttcctccgttctcactttgtttttactctctcttgatttcttattttatctcttttctttcttgtttttccgctcttttcttttctttactctctttttttctctctctctcctttctctttttctttcattgtcttgtttttcctcgtattttctttttcttttttttttggttacggtcgaatcttgtggagattgcctacgtatcatgaccctgcatgaatcaggccaaatgtagttctttgagataagagcgaaataaaacatttttgggattttcagttttcataaaaaaacaaatgcttccattacaaaactcaaaaatagaaacttccaaaagattaacagatttcgatgcaaagatgaaatacagactccgaaaatagacatcatattccaacagaagaaaatatagactcgaaaacaatttgacagactctagcagaaagaaaaacttaacatgcctgacagacgcttaacaaaagagaaatgcagactcaagcgaaaaaatcatgaatacatcaatgctcctggtgtccgcgggacatcattcggtctcgccacaggcctatatgcaagctccctttgaagtcaatcaaagtcgttcattatctgtttaacaaatgtcattactgctgcaatgaaggtagtgcgggtcatatcctcacaaatctggaacttcataacgatgtagttagcaatgcttctaattatctctcttatggcgcccttttcttgtaacaaatgcccaatctgctgggccatggcttccaaagtttgctcagccgtatgattttgctcctgaagttgttgcaaatctatttctaattttgccaatgttgtataacaatgttccctttcaactttgaagtcttttgcctgtttgataattttgttttccatggcgatgaccctcttctttaaccctgcgacctcatcgtcgtacctttctctcaactgcttaaccaggcatactcgttcatctgcatttttagacaattgctttcgagccttggctagttcactttctgctttattcaaatcaaaactatagtcatttactttctgcctcaggttagctatgagtttttcatctctgtcgcttcgggatggattttttgccactaccatcattttctgaatttgagctcgaagggcctcatttttttaatcaactttttcttttctccttcattcaccgcgacttgcaggctattctcgaattgaagttctctgacttgcttttacaatttgcttatggtagccctgtactcattttctttggtcagctagtcccattgcacttgtgctccgttggtgaatcattggacatggggtctctttgcgggcctgtcaagttcatattgaactcgagatcttttaccataccaagcagtgtaactaggctccacctcgcctctggataggtctcgtacttgagtattaggccctaagaatctgcactgatgccaaatccggcgcactttctcttttatgaaggcaacttttggatctaactcaatgacttgctagctcaaatcttcgtcgtgtgggatggtctggtaacggcccaactgacgcaagactctgtgtggagcataatgctggatactccgaagacccatcaacagcaacaaacacacctcaaccgacatatagattactttgttgaccttgagccacccaaatgtccattcgatcttattagcggtcaaggatctcgaatgagtatgccgtgcttccgtaccatctggaagctcataatcctctattctcttttcatgtttttcaatgcactcaaggctagttataccgcaattcaagtagccgggacggtagcaaaggtgttcctccatccatatttgtaacaacatattgcaccctttaaaaaactttgctccttcttgacagagagtgagagctcggtaaatttttgccaagatcagcggcactatagtcccatttgcctttttcaacataaagtcgtctatccctactatccccatctctatgttcccatcttttctcgggcaaaccaagacacccaagaacgtcactatgcaagctaatcctcttcgagcttcccacttgtcttgatttccaacatgagtaagaccggtatctggtgtttcgaagccacgtcgattcccgtaacgtcgatacagaaagtagaaggtacaaaatcctttagccagatttccgtatcggatatcccgactgatgcttaacaaatccaaaaatttgtgggaagtcactattcttggtgctatcgggtattgacttctgatattcccttcgaaaccggcatagcctactatctcttctagcgtaggatttaactcgaaatcagcgaagtggaacacattatgtgttgggtcccaaaacggtatcaaggcctcaatcacgtcttttctgggcttgaccttcaaaagcccaataagaccgcctagttcttttgtcacaactttcctactgttgcccctcaaatcatgccaccacgtatgtagctccagagggatctcttcacggactgagaaaggttcattttgatttgtgctcatcctgcacatttattaaggtgattgtaattaaaagaaaaccatgactcttttgacttaagagaaatgaccattttcaaaatttccacaaaacattcggccttgccaacacgacctttcagcacttcgaaaacgaagattttaaggccgtgtcagctaaccagccaaaacctttaaaagcgacaaaagtggttgttcttgcaaaagcagacttctggcgcccttttagggacattcgactatttttgacaagaacgacatcaccataattattaaaaataaatttttttcttttggctactttcgcaaaaaagaagttggacccgatgggggttgcctacgtatctcataccctgagagaatcaaactggcgtagtttgggtaaataaaacaagctactttttatttgaaaacgactgtttttccatttcattggcaaataaaactatttttgaaaatgccaacctttgtttctcctcttttttttgtttttattttctcaaaaattcagtagagtttcgacactgtttggacgttgggtttttcttctttttttttctttttctttcttctttttttagaagaggagattaaatctctttaaccctcatactactattttcctcaacttttccaaatattcataaatcggtcagcatgaagtagaaagtaggatgcatcaagatggtcttttagtttcgggtgcacctgtcctagacagacccaacccctgtgttgagtatccaaagccaaaatgcacatgatgcaaacaaacgttcctaccagggatccggcgtgaggtcttgttatactaggttcaaaacctgggtttattattctagacctagcttacccgagcggacagctcgagccgaggggggcagcgtaccgggaatacagaagcttcaccggctttgcaacttgtccgaacctcattctaaatttggaatatgactctaacagaaacgaagtcacatgaagtgcacacttcttcatgatttaactcagagagaagagggatttcacaacagtttatatacagttcacggaatatcaaagcggtaaaagcaatcaattagcacattaggcccaaatcatataacaatttcagataatggataatgccaactataacaattcatcccagctcgaattcttgaaccctgaactagagattctgggttcgatctccagtagagtcgccagagctgtcacacctcctttttcactacaccccgtaaagggtataaatacaaaggagtttttccaagtaaaggacaatcgaaacgggatgtatttatttaaagatttagagtcgccacttgggataatttatggtgtcccaagtcaccgattttgaaacccgaatcgaggaaaaaatgactatatttaatagtccgcgaactagaaatctgagtaaggaattctgttaacccgagagaaggtgttaggcattcccgagttccgtggttctagcacggtcgctcaactattataattggcttaactatcttattttaatcaattatgaacctatgtgccaatattcactttttaaccgcttttaattaatttttaaagaagattgcacatcatttaaaacatgtccttggatcgcgccacatgaaatgcacccgcaatcctaaacatattttattcaatgttttaagacttgatttgggtcacataaaatgcacacccgagttttaggaaggtaaattattaaaatagcggcctaaagcaactacgcgtattaattttgcgagggccatggaaaatacgctaaatggtgcgcctcgattctaatttcgagggccataaaatatatgtttggctaatatggcacacctcaactatttaatgagtgtaattaattgattaaaagacataagggaatttctacttattttaagacaatgtttgagttaaactttaataactaatgagctagtaatagacaaaaccaatgtttgattgttgaaaggcctaggctggctgtaagcccaaagactggctgcccattactacctgcccagcacgagagacaactaggctcactcatgaagcccagacttataatctaattgcagaaggggaaattgatcacaaccgggccaacgatggcagcccaatttcaagatttaaaactaatacttgaagtaaactacattgttatggagatttagagtttgaaaaacaccaacgaccttgagccaatgcaaaacacattcttgatgctatcatacatgctgaaatgaagttacagttcctgattatcaatagcttatatgcaggtcgtttcatcattgaaagtcaccaattcaaattttcagcaagaagaaaacaatttaaagtttcagaaagacttcatttagtaacaatggacttggaactgcctaactctaaaccttgaaaagaaagcaaacacgggttgatttcacctaaatcaaataagagattttcctgtattgcaacatagcacacttcatgctcaaagaacaaccaatcttatgcatcttaaagtctgaactactactaatcaacattgaaactaaatagtggctttagtagagtattacagccatttgaatcagctatgaaaatataataacatgcaatgaatttgttcaaatgcctaaaccaaaatctggaagaggtaaataaccacaagttaattaataggactatatgattacagaaccaaataatcaaaaatagactgctgtaaaacatggtatcatcaacattctcatttccatttaaacatgtcatttgaggtcgaatgagtacctggttacagcaaagataaacgaagagctttgagaatcagcttaaagcaaaaccaaggtagcaggtatagcagcagaggtcagcagtaaaaccaaatcaaacagtttccaaaaatccaacaatttcagctctttaaaccatttttacatagataaaaccagagttatttgaagccttttaaattccagttgaaacccaagattagggagctgattcagatctaattcccaccccaaaagaagcaaaaatttcaatgtattttcagaataacgtcactcaaccgtttttgcttttcagtatttttggagtgttaaaaagctgcttggaaataaagggaaagagatcatatataggcatgcctaaggcagccctagtacaactgaccaattccctctctaccccttctttcttagttgtttttaccatttttaaccttttagaaaaaatatttgaaaccctcaactctcatcttatcctctagaaccttctatgcttacagaaaatgattccctcaaacctcaaatccctaaattgacccttgacccctgtattaaccctcaggcaatcaaaattaggtcaagttatccaaagacccagcccaaacccatgggtatgtatactacaacacaaacttacaacttcagaccatcaatcaaagagcattgaagctcaaatgacccgggatgttcaggtcaaacgaaagaaaaatgcagggagggaaaacaaacgagtctcagagaacttaaatgatttaaaccaaaaagaaagaaaaaaacatttaatcattttagcaataattcgaaccttataaaccaaaatcgggtaaaaccaaacaaatgaatcaagcaaaataaacagtgaacaggcaacttaagagcatttaatcacaattatattctcaatgaactatgttaatgagaattcaaaggaaattagaaaaaaaaatgatacaaagaaagagaaacacatactaaagctatcagagacaggcatcgtttaacaaacttgttggttttgtgtattgcatgaggccgatgagcttcgaaacgaatcaaagtccatgctagtcactcgttctcaaggagaaaagtcggctggcataaactttgtaccgttatcagcctagaaatgcttgaactctgacaaggggagcaagattatggttcatggaactttggtctttgatctgagatttgacgagctaggctatgattcgaaggtaacgcactggagatttgggatgaggggacgaaaggggttccagggtgttattttggggtcagaccaaggtggcgccgccccagagaacacaaggaaggctctagggttttcttacaatctaagattcgagacgtcctaggcttgatcgatggaaagtgctcgtagatttggactgagggagttgaggagggtatttggtgtaaatttgggtggcgtttggaggtcgcgctgccaccggaggcccggcatttgggggcagcttagctaggatttcggggtgtttgtggtgaaagtggtgagccgaagggattctggggggggaaaggttttcggacagttaaatatccctggggcttcagttctgagccgtttgatcaaggggagatcaatatctcagattgatacttattgaaacgacgtcgtttagtttgggggggcaccgactgggtcaaggcgtgggtttgggccaagtattgggtaatttcgtttgggctggggacaattaaatgggttttagcctagatttggattttctttcacttctttcttttctttttttcaacttcaaaattcttttctttgaaaaattaaaataaaacctaaattaattaataataatttttaagctaaattaacctatccaattagattaatcactcatcatggtatttacaataattaattaaattctaaattaaaagaaaaattatacaattcaaaattaaaaagtaaaaatgcaaaataaattatttttctgtgattttcattttttataaacaaactaatttactaattaatctaaaaatataaaattaaatcctaaatgcagatggaacatatatttttgtatttttcatgaattaaataaaataaacgtgcacagacaaaagcaaataattaatagaaaatgccacaaaatttcaaacactgaaagaaattattttgttttgaatttgttgaagtaatatatatagggcaaaaatcacatgctcacaatagagatgtttcggtgttatttgattcaaggtctacatactcatatgtgtcatcttattttgtatagtatctggtcatgcctagtgactctttgagtgctcctgtttatgtgtctacaccggtaggtgattgaattttggtacatctagtccatcgttcatgtatagttgtgattgggggtcttgagactcgcgtagatttgttacttctggacatggttgatttcgatgtcatattggggatggactggttatcaccttaccacgctatcttggactgtcatgccaagactgtgaccttagcctcaccgggtttacctcgtttagagtggatagggactcctggtcattctacccgcagtgttatttcgtatgtgaaggctcagcgtatggttgagaaggggtgtttggcttatttggcctatgtcatgattctagtaatgaggtcccatctattgattctgtgcccgttgttcgtgagtttcctgaggtattctcttcagacctgtcaggtatgccacccgacagggatattcacttttgcattgatttggcttcgatcactcagcccatttctatcctgttgtattgtatagccccgcctgagttgaaaaagttgaaggtgtagtttcaagacttgcttgagaagggtttcattagacctagtgtttcaccttggggtgcgccggtgttgtttgttaagaagaaagacggatcgatgagaatgtgtattgattaccgccagctgaataatgttacaatcaagaataagtattcattgctgaggattgatgatttatttgatcagctttaggctgccaaggtattttcgaagattgacttgagatctggctaccatcagttgaggattaggacatccgatgtccctaagaccgctttccgcacttggtacgggcataatgagttctaggtgatgtcattcggggtgacaaattccccaagaacttttatggatttgatgaaccgagtgttcaggccttacttggattcgttcgtgatagtcttcatcaatgatattttgatatactcccgcagccgggaggagtacgagtagcatcttagagtggttcttcaaaccttgtgggatagttagttatatgctaagttcttgaagtttgagttatatttgacttcagttgcattcctgggtcatgttgtattagcagagggcattcaagttgattcgaagaagattgaggtagtcaagaactggcctagaccagcatcagctacagagattcggagtttcttgggattggaaggctactattgttggttcgtagaggggttttcatctatcgcagccccgatgaccaggttgacccagaatggtgcccagttcagatggtcgaataagtgtaaggcgagcttccagaagctcaagacagctctgactatggcaccggtgttggtttttcccacaggttcagggctatatatggtctattgtgatgcatctcgtattggacttggtgcagtgttgatgcaggatggcaaggtcattgcctatgcttagcggtagttgaagattcatgagaagaactatcttgttcatcatttggagttggcagccattgttcatgcgtttaacatttggaggcattatttgtatggcatgtcttgtgaggtgttcacggatcacaagagtcttttgtatttgatcaagaaaaaggagctgaatttgaggtagagaaggtggttggaattgttgaaagactatgatatcaccatcttatatcatccgggaaaggccaacgtggtggtcgatgctttgagtaggatgtcagccagtatgggcagtcttgcttatattctagtcggtgagagacttcttgctttggatgttcaggctttggccaatcggttcgtgaggttggatatttctgagcccagccatgtgttagcttgcacagtcgcttgtttttcattattggagctgatccgagatcggcagtatgatgatccccatttgtgtgtccttagagacatggtgcagagtgccaagcaggttaccttaggtgatgatggagttttgaggttgtagggtcgagtttgtgtgcttaatatggatgggcatcgagagttgattttagaggaggcctatagttcccaatactctattcatccgggtgtcgctaagatgtatcaggatttgcggcaacattattggtggaggagaatgaagaaggatatcgttggatatgtggctcggtgtttgaattgtcagcaggttaagtacaagcattagagacccggtggttttttctagaagattgagattcctgagtggaagtgggagcgtaccaatatggactttgtgattgagattcctgagtggaagtgggagcgtatcaatatggactttgtttttggactcccacggactcagagaaagttcgatgcagtgtgggttattgttgataggccgaccaactcagcacatttcattcatgtggcagtctcatattcttctgagaggttagttgagatctatatatgggatattgttcgtcttcatggtgtgcctgtgtctatcatttcggaccaaggtacgtagtttacctcacttttttggagagcagttcagtgagagttgggcacacgggttgagttgggcacaacatttcattctcagacggacgagcagtccgagcggaccattcagattttgaaggatatgctccgatcttgtgtcattgactttggaggctcacgggatcagtttttgcctttagcagagtatgcctacaacaacagctaccagtcgagtattcagatggccccgtatgaggctttgtatggtaggtagggtcggtcgccagttagatggtttgagacgggagaggctcggttgttgggtacgaatatggtttaggatgccttggacaaggttaggattattcaagataggcttcgtacaactcagtccaggcaaaagagttatgccgaccacatggttcgtgatttggcattcaagtcggtaagcgggtattgcttcgagtgtctcctttgaagggcgtgatgaggtttgggaagaagggcaagcttagccctaggttcattggcccgtttgagattcttgatcaagtaggagaggtggcttatagacttgcattgtcgccgagcttagcagccgtgcatccagtgtttcatgtgtccatgcttcgaaagtatcacgtcaatccatcccacgtgttatatttcatcactgtccagttggacaaggacttgtcttatgaggaggagcctatagctattctagaccgacaggttcgtcagttgagatcgaacagttttccttctgttcgtgttcagtggagaggtcagcttgttgaggcatcaacctgggagtccgagttcgatatgcggagctgttatccccatcttttccccaatacaggtacttccttcttatgtttgttcgaggatgaacagttgttttagaggtggagaatgcgatgaccttttgcgtgcgtagtccgggcgcgtagccggaaagatattatgtgaatatctatgaaaaatgataaattttgactataaaatgaattaatttgacttcagtcaacattttgggtaaacggacccagacccgtaatttgacggtctcggagggtccgtaggaaaatatgggacttgggaaaatgcccgaaatcaaatttcgaggtcccaagtctgcaggcttcgcaaatgcgaagcttggattgcaaatgcgagacctccatcgcaaatgaaaaaaaaggacttgggcaagcctgatcgcaaatgcgaccacttggctcgcaaattttgaaggcccagtcgcaaatgcgatgcctgcttcgcaaatgcgaagttctccttttgtgtcggaggtcgtaaatgcggcccaaccttcgcatttgccaacatagcaattcccacatctgcaacctacaacttttatacttagacgaatttttaacccattttcatatcctctcaaaacataaacactctaaggcgatttttcaaaggcttcttcgtctccaaatcaattgtaagtcatttttaactagttttcttcaatccttaacatcttctaacatgatttcaactcaaaatcaatgagtttcatgggggaaattgggtgttttgggtagaacctaagttttttcaaaaattggggatttggacctcgatttgaggtccgatttaaaaaaaacataaatatttggtttcatggggtaatggggaatcgggttttggtttgaacctcgagttttgaccatgcgagcccgggggcgatttttgactttttgggtaaaactttgaaaaactcattttcatgcattgggttgatttatttagcatttattgatgtaattaagtaacttgtggccagattcgagcgaattggtggttgaatcaaagggtaaagctataattgaaacgtgaattgtgttcgtggcatcgaggtaagtgttatgtctaaccttagcttgaggtattaggattcgtgtcttatttgttacgtgttaattgtggagtacgacgtataggcatggggacgagtatctatacgttagggtcaagcatgcctgtgaatcttgtattataattgttatgactccgttgtggtttatagtgtttcacatgttattattatcattgttcccttgacgggatgtttgtttgatatcattgttcccttgccggtatgtttgtttgatattattgttcccttgacgggatgttgttgaaatattattgttcccttgccgggatgttgtcgaaatatcaatgttcccttgctgggaagtcgcaatattactcttgttacctagccgggattctttgtggttgttgttgatttgtaactgggatcgggtggcacgcctgccacaagataattgaaatgggagagggaggcacgcctgacacaagataaatgaaatgggagcgggtggcatgccttccacaagataacttaaatgggagcaggtgccacgcttgccacaagataaatgaaatgggagcgggtgacatgcctgccacgagataaatgaaatgggagcgggtggaatgcctgccacgagatacatgaaatgggagcgggtggcacgcctgccgcaagataaatgaaatggaaacgggtggcacgcctgccacaagataaatgaaatcggagcgggtggaacgcctgccacgagataaatgaaataagagcgggtgtcacgtctgccatgaggtacatgaaatgagagcgggtggcacgcctgccacgagatacatgaaatgggatcgggttgcacacctgcaacaagatgtaaaataaaggtgaaatctgcctttgtttttggttcctttataattctcttgatattctgtttttacctgttattccccgaagcatgttttcctcctaccatatttacttgtttatttctgctttactttacgttgtatattatataactgcacatgattatttggtagtctggtcctaaccttgtcactacttcaccgaggttaggctgggcaattaccagcacatgggttcagttgtgttgatactacactctacactatgtgcagatcccggagaagctcttggactatagttggaggctaccttcagtccacgcggagatccaaggtagacctgcaggcatccgcaggccctgacacctcctctatcttttatatcttgtttcatattttacttcagaaatagtgtgtcttttactttcagaccttgtatttagcagtcttagattgggtgattaaggcttctgcagttgtaatagatacagatttaagatattttattgtttccttctacttaatttaaatttcagttgtttatgtgttattgtttatgttttaaaaaaaagaaacaaatgggtaatgaagtaattagtttaaaggattggcttgcctagctcacactagtaggtgccatcacgacccctaagggtggaaaatccgggtcgtgacaggaattatttatgagttttggaaatgaaatgcatttagaatttgatggtatcgggctcgtattttggttccggagcccggtacaggtcttatatgtgatttaagataagtttgtaaaatttggtaagaaacggaagtcgtttgagttgtttcggacccatagttgtgaaaattgatactttgaaagttttgaattttttcttagatttctatgctaagttcgttgtttaagaggttattttggctatttgaacacacggataagttcatatgatacttttgagttagtatgcatgtttggtttggagccccgagggatcgggtgagttttggatgggtttctgaaggttttgaacttaggaaaaattgtaggttattgtgttttgggaaaaatggattggttacgagttccttattgttttactgtaaattctaaaccttatgtctttctcttaatttactgttgatattgatattcccccacagcatgtaccccctcccatctttacttggttattcctgttttattttccgtagcacatatataactgcacatgtttatttggtagtctagtcctagcctcgtcactatttcgtcggggttaggccaggcacttaccagcacatggggtcggttgtgctgatactacactctgcactatgtgcaaatcccggagcggcagcttttggacagtagcattgggcgggtgccttcagtccagttagagatcccgaggtagtcctgtaggcgttcgtaggcccgacgttctcttctatctttatatgtattctgttttcatttacttcagagacaaattatacttttgtttcaagacatttgaatgtagtattcgtagttggtccgtgatattgtgacaccggatccgggtagagatgtatgttggtattgtcgtactggtttggctaagttatcggattaagtcttccgcatgtatttatttatcgttaatatttcattgttgatcacatgttaatttaaattgttaaaagtgataaataaaagagttagtgattctatattacacggcttgcctagatttcacgagtaggcgccatcacgactcccgagggtgggaaatctgggtcatgacagtatttatttcattcagacctttgtttgtagtactcctagacaatttgtgaagttgtgataccaatcttgggtagatttattatggatttgtattggcagtattattaaatctttacactgtagtcttccgcttattcaattatgttattatctaattgttggctctaaactgttatcggattaaaaatgaaaatacggtaaatagttcaattggttggcttgcctagctttcactagtaggctctatcacgactcctgaggccgggtcgtgacatttttggtaccatccttgccagtgtcattgaatcctaaaaatagttaggaagcaaaagaacaactcatatttattgcaaaataattatattttgagactatgaatgactcattggataagacttaactctttaactactacttgaactcttatttagtgtgttgctatctcttaaaaaatatttctttcttaaaatttcagtttctaaaacattatttttcaataataattatttttataataatgtattgaaaatattattcttaattcaaaactcattttagttggctatctaaaaatataaaaaattctttagctagtgaattctttttattccattttgatatttgacattaaccatgtcaaatatttgagttatttgaattatatgtaaataaccttaaaatttaaaccttctaaataattatagataatcgtcagatattaattaagaaacactacatgaaaaaacactaacattttctcaattctcgtagtaataattttatttttgcactattctcataggtgtcattggaacctaaaaatagccacaaagtgaaataataactcatatttatggcaaagcacaaaagttgacacgatataaacgattctttggttacgacgtgactcttatactacgacttgaacacttatttggtatgattttatctttcaaaaaatatttcttttttgaaatttcagtttctaaaactttatatatattataataatgattgtctttataatgatgctagtgaagatattatccttaatttaaaattcactttaatcggctatctaaaaatttaaatgattctttggccggatttatttcagtatgactccactttaagtttatcgatatctctatccctagaatttaaattttttataccctatatatacaaaaaaattgttctttgaatcattaaatattaaattagttgattattattattattattataaaatattgcatatattgtcttaaaattgtcaagtagtttattttcgacatcatacttggcttaacatcaatgcaaactactcaaattgcattccaattcaaattcgactatcatatcagcttgttagtaatagtgattttttaaaaataacatataatgtaaattataaaaatattctaagatatccttattttataatctatgtgtttgagtaaaaaaaaatatttaaaatcgatgagattaaccttaaaaaattttatactgaacaaagatgaaacataagaagaaatttgttgtcatcttttatttcacgttttcagatctttctaacattttttcaatgttcatttatcttacttttttatgtcattatttcttttgttacaaaaaattaatttatttcactataaaaggacgagtttttataaaaattgtctacatatgaactttaattacatttttagtctttggttgaagttatttcatatttttcttttggctttatctaatcagcctaaataggtactcaccctaccacttaaattaaaaaattgaatgatatgtaatttatatataatccatatataatatgtgtataatcatatgttgtcggtatatcatctatttatattagctataaaaagtaaacaataaatatggtcgattattatgtaaatattctataagatttcgattttttgagtttatccatgatataaattctattataataattttaaactctctacgaatgttcaaaaatatcttatctttttattatctttgaattaaaaaaattaaagagtttttttatgatgacccagtcatcacttattttaaaagaaaattctgcatttctaggccttagaaacctctttctatgtcacctcgatttgtgtgtacagtccgagcgcgtagccggaaagccaatatgtgaaaatctgtgaaaaatgatgaattttgactttaaaataaattaagttgatttcagttaacatttagggtaaacggactcggacccatgatttgaccgtcccggagggtccgtaggaaaatatgtgacttgggcgtatgcccgaaatcaaattccgaggtcccaatcccgagaaatgaatttttgaaagaaaatattttgctaaattaattatgaagtaaagaagagaatttatgttggaaaccattggtatcagacccgtattttggttccggagcccggtacaggtcttatatgtgatttaagatgagtctatgaaatttggtaagaaacggacttgaaacgacgtgaatcggatcgtatttgagaaaattggaaaatttgaagttcttaagaaatttcatgattttgatgttaaattcatagttgttgatattattttgggtgatttgaatgcacgagcaagtccgtattatattttgaggttggtatgcatgtttagtttggagccccgacggatcgagtgagttttggataggccacggagtagaattggacttgggaaaattgcaggttttcaactggtattgtcaggtctgcaggcttcgcaaatgcgaagaatggacctaggcagccttagtcacagatgcgactgtcgtcttgcaaatgcgatttcgcatttgcgaatggtctctcacaaatgcgaagatgaccggaaagttgattgggtcgaaaatgcaaaagtcccagtttctgaagggttcacaattgcgaaccctggtcacaattgcgatatcagagacctataaattcacacttagacgcattttcaactatttttcacatcttctcataacataaactctctagggcgatttttttcaaaagcaacttctcttcctaatcaattgtaaatgattccgaactatttttcttcaatctataatatcttttcacatgatttcaactaaaaatcaataatttttatggagaaaattgggtgttctgggtataacctaaggttttccaaaattggggatttggacctcgattttaggtctgatttcaaaataaattatatatttgggttcatggggaaatgagtaatcgggtttttgttcgaaccacgggttttgaccatgtgggaccggggcgatttttgactttttaggtaaaactttggaaaacttattttcatgcattggcattgattcatttagcgtttattgatgtaattaagtaacttgtggctagatacgagcgagttggtggtggaatcaacatgtaaagcgatagttgaggcttgaattatgttcatggcatcgaggtaagtgtttggtctaaccttagcttgagggattaggagtcgtgtcttatttgctacatgttaattgtggagtacaatgtatcggcatggtgacgagtatctatatatcggtgtcaagcatgcccgtgagtcttgtataataattgttatgattccgttgtggtttattgcgcttcacatgttattatcattattgttcccttgttgggatgttattatcatattattgttcccttgccggatgtttgttttaatattattgtttccttgccgtgaagttgttgaaatattattgttcccttgccaagatattgttatattgctcttgttcccttgtcgagattcttttgtgactgttgttgatttgtaacttggattgggtggcacgtcgccacagaaatatatgaaatgggagtgggttgcatgcctgcaatgagatatatgaaataggagcgggttgcacgcctacaacaagatatatgaaatgggggtgggttgcacacctgcaacgagatatatgaaatgggagcgggttgcacgcctgcaacgagatatatgaaatgggagcgggttgcacgcctgcaacgagatatatgaaatgggagcgggttgcacgcctgcaacgagatatatgaaatgggagtaggttgcacgcctgcaacgagatatatgaaatgggatcgggttgcacgcctacaacgagatacattaaattggatcgggttgcacgcctgcaacaagatgtgaaatgaaagtaatttctgtatttgttttccttatccttgttagtaattggattttggtttctttatattcctcttgatattctgttgttatatgttattccccgaagcatgttttcccccatgtaattaaatgcttttatttttccgatgtatatgatttaactgcacatgtttatttggtagtctgatcctagcctcatcactacttcgccgaggttaggctagacacttactagcacatggggtcggttgtgctgatactacactctgcaatgtatggagatactagtatcggagcatttggaccgcagtgaggttgctgccttcagtccaacaggcgaccctaggtagttctgcacacgtccgtgggccttagcgtcacatcctatctttcctttatcctgtttcctttaatttttttagaaacagtgtatattttatctttcaaactttgtatgtagtattcttagaccgtctatgaaactgcaacaccagttctgggtagtttatgcttaaagagttgtattagatacatattcagataatttattgctttgttccgcttattgtaaatttcgttatatacacgttattgttttataattgttaaagaatataaaaggggtaaaaacataattggttcaaacaatcagcttgcctcgctcatattagtaggcaccatcacgactctcgagggcgggaaattcgagtcatgacaagttggtatttgagctctaggttacataggtctcacaattcacaaacaagcttagtagagtctgatggatcggtgcagagatgtctgtatttatcccccagaggctacagagttaggaaaacttcacatttattctttcctgtcatgctgcttggtttctcaatgctaattaaatttctactcttttctttcgcagatggtgagaatacgtgcttcctcatccgctgaacagcagcccgagcccccagcagcagctcccatgaggggcagagggcaaggttaaggccgatctagacgtcgaggtaggggcagagcttagcctagagcagtagcaccagcgacggagcctcgggttgacattgatgatgaggttccagccccgacagtttcggtgggccctgctcagaaccaagaggggtttcttgctacccccatactccaggatgctctggtccgtctagatggccttatggagagtgtcacctaggcaggcttgcttcctgtagcaccagccatctctcaggctgaaggaggagcctaaactcctgctactcgcactccggagcagatggctccctagtttcagcctccagcagctcagccagttggagaagttcggccgggcatggtagctcaggccggtgatggagcaactatgtctgccaatgcttggtggagattggataggttcaccaagctcttcactactactttcaccggtgcatcttctgaggatccccatgattatttagatagctgtcatgaggttcttaggaacatggggatagtggagaccaatggggtcgattttgctacttttcacttgtcgggatccgccaagacttggtggagagataattgcttggctagacctactagattgccagctttgacttgggagcagtttactcagctatttctagagaagtttctccctatctctcatagagaggcctatcagaggcagtttaagcgtctccggcagagttctgtgactattactcagtataagactagattcatcgacttggcccgtcatgctcttatcatacttcccatcaagagagagagagggtgaggagtttcattgagggacttatccagcctattcgactttaaatggccaaggagacagggagtgaaatttctttttagaaggcgaccaatgtggccaggagagttgagatggttctatcgcatggaggtggtcaggggtctgacaagaggccttgctattcaggcagattctgtggtacctcgtctagaggcagggattcgtatggtagaggccatcctactagggctttttagtcagcacttcaggtttctcacagtgcttcaggtggccatggttatcatatgcagtattctgaccaacagtcctacagtgcaccaccagctcctatcactacaccgccactttagaattcttacggtcgtcagccccagcagccgagggcttgttttaattatggcaacacgaggcacatttctaggtattgccctcgagcatcgagcagctctcagcatcaggcttcccgtgccatggttcaggcaccgagtgttccatagcccgcccagccagttagaggtaggggtagaggtggaggtagaggtagaggtattagaggtggaactcaggccgctagaggtggaggccagagcagcaggccatcctagagatgtagttcagagtggtgggcccagccccgatgttatactcttccagccagacctgaggctgagtcttccgatgcagttatcatagtgattctttgagtgctcctgtatatgtgtctacaacagtgggtgattctattgtggtaggtcgagtccatcgttcttgtatagttatgattgggggtcttgagactcgtgtagatttgcttcttctggacatggttgatttcgatgccatgttggggattgactggttatcgccttaccacgctatcttggactatcataccaagactgtaaccttagccttgccaggtttacctcatttagagtggagagggactcttggtcattctaccgtagttttgtctcttatataaaggctcagtatatggttgagaaggggtgtttgacttatttggcctatgttcgtgattctagtgttgaggttccttctattgattttgtgcatgttgttcgtgagtttcctgaggtatttgctttagacttgccaggtatgccacccgacagggatattggcttctgcattgatttggctccgggcactcaacccatttctatctcgcagtatcgtatagccccacctgagttgaaagagttgaaagagtagttgcaagacttacttgataaaaaaggtctcattagacctagtgttttgccttggggcacgccggtgttgtttattaagaagaaggacggatcgatgagaatgtgtattgattaccggcagttgaacaaggttacaatcaagaataagtatccattgacgaggactgatgatttgtttgatcagattctgggtgccaaggtattttcgaagattgacttgagatttggctaccatcagttgaggattaggacatcagatatccctaagacagttttcgcactcggtacgggcattatgagttattggtaatgtcattcgggttgacaaatggcccagcaacttttatggatttgatgaaccgagtgtttaggccttgcttggattcattcgtgatagtcttcattgatgatattttgatatattcccatagtcgggaggagaatgaccagcatcatagagtgattcttcagactctgacggatagtcagttgtatgccaagttttcgaagtgtaagttttggttgagctcagttgcattcttgggtcaagttgtatcagcagaaggtattcaagttgatcccaaaaagattgaggcagtcaataactggcctagacctgcatcagctacagagatcgggagtttcttgggattgccaggctactatcgtcggtttgtggaggggttttcatctatcacagcctcgatgaccaggttgacccaaaagggtgcccagttcaaatggtcggacgagtgtaaggcgagctttcagaagcttaagataactttgactacgacaccggtgttggttttgcccataggttcagggccttatacagttaattgtgatgcatctcgtattgtacttggtacggtattgatgcaggatggcaaagtgattgcatatgcttcacgacagttgaagattcatgagaagaaatatctggttcatgatttggagttagcagacattgttcacgcgttgaatatttggaggcattatctgtatggcgtgtcatgtgaggtgttcacggatcttaagagtctgcagtatttgctcgagcagaaggagataaatttgaagcagagaaggtggttggagctattaaaggaatatgatatcaccatcttatatcattcgggaaaggccaatgtggtggccgatgctttgagtaggaagttatctagtatgggcagtcttgcttatattccggtcagtgagagaccgcttgctttggatgttcaggctttggccaatcagttcgtgaggttggatgcttctaagcctagctgtgtgttggctcgcatagtcgctcgttcttatttattatagcgtatccgagatcggcagtatgatgatcctcatttgtgtgtcctccgagacacggtgcagcatggaggtgccaagcaggttaccttaggagatgatggagtttagagattgcagggttgagtttgtgtgcctaatgtgtatgggcttcgagagtttattttagaggaggcccatagctcccggtacaatattcatatgggcgccactaagatgtatcaggatttgcggcagtattatttgtcatgatccaaaatccactaagggtcgtgacagcgccgaacaccactgccaggcaagccaaccacaatttactagcagtttctcattttaattattttgaaatcatttcctttaaaccaataaataataaataataaactccgctggataaataaggatgtctttacaaaatttaactattgaaaaatcccgtgatcatcccagaacccggtgtcacaagtacatgagcaatttctaggaaataatgtagtacaacaaccgtccggaatacaatattggacagaaagtaaatacagtaatttgaaagagacactgctagttgcgggtcgtctagagaagtgcagctcacctactctccgtatcaaccgtgctgttatgcctactaggccactagagatgcatgtgcatgtgcaacaaaaatgcacaacaagtgtagtatgagtacgaaaacaacgtgtaaccaatgagtatcccattaaatctcgaagaaatagagacgagaggtcgactttgacatttactagtggtccaataataatatagtgaaaatgtgaggaaatcatggattcttataaagcaattataaactcgtaaaaccggatagcaggtaaacaacatctcaaataaatacggatttccaaggtttacttttcattatgcttatcaactatgtttggccagggaaggaaaatattatcacataacattctcaggcaagcaatacaagcatacacatatcatgccgaggccgtacggcccgatccaacaatatttaaatggtgcactgccgagggtcgaacggcataaactatagatggatctatttaatctacagaggtgttcggcccgttccaaagataagcacacacagacactcaatcaagaagtcaacatggaacaattatccaaagaaaagccaattctcttgtaacaatttaagaaaatgaagtttaaatccttttagaaattcgtttactaattcgatgtgatttaagcaattcagctgtcaataagattacaaatatcccaagtatagcatgcttttaggtcctagactacccagacttaaacataatacgagctacgcacggactctcgtcacctcgtgcacgtagcacccataaataggagcacataaccaattatatcacctatgaggacaattacctcttacaagattagaaaggagactcatctctctccgcagcatatatttcgactcaagaacgcgctcaaacctccaatttggagccgaacgatccaaaactattactatagggtacgaactagtcaatacatgctcaaaagttcatattctaattattaaatcagtttcccaaccctaaatgcaaggttcctaaaattcatcttcaggcacacgtgcccggattctgaaattttccgaagaaagttgttctcaataacctaaggatcaataatatatgatttctaatccatttcataaccaattttgtggtaaaatctaagttttattaaaaccctaggtctagctctaaccccttgatttctccaaatctttaggtgttaatttacccaaaacgcaagtgttaaacttagagataagggtgatgaacttacctcacgatgctatatggaaatcccttctcaagagctccaaaatcactcaatacctgagtgccaaatggtcaaaaatggttggggctcgacttaaatatagctaactgcttcagcagtttccgcatctgcggtcgggggaccgcatctacgaagggagggcgcatatgcggaattggctaaaagggttgggacttcttctgcgatcttgaagccgcatctgtgaagtcgcttctgcggcagaagagccacttctacggtttggactggccatctctgggcggcatctgcgaggctacgacctcttctgcggtctcgcacctgcagtcgactaaccgcaggtgcggttatgacagaagcagctgcttcaacacttctccaaattccattttcgttctggaatccacacgaggcccccgggaccccaaccagtcataccaaccaaacctaaaacacattacggacttgctcgaggcctcaaatcatatcaaaccacgctaaaaccacgaatcgacctccaatccaagcattatgaactttagaatttcaagcttctactttcgatgtttaaacctatcaaatcacgtccgattgacttcaaattttgcacacaagtcatatttgacattatggacctactccaactttcgaaattggattccaaccccgatatcaaaaagtccacttccaatcaaacttcccaagaaccttcaaatttctatctttggccaaatgactccaaaatgtcctacggacctccgaattcacttccgatcgcgctcccaactccagaatcaccatacggagctactcccagactcaaaatcccaaacggacatcgattacaccgaaatgcatttcaacccaaacttatgaaattcttccaaaatgctaacttccacaataggctccaaattgctcccgggtcatccaaaacccgatccggacatacgcccaagtccgaaatcatcatacgaacctgctggaaccttagaatcccgattccgaggttgtttactcaaaaatcaaatcttagccaattctttaaacttaaagcttccaaaatgagatttgtctttccaaatcaactccgaacttcccggaaatcaattccgaccatgcgcacaagtcataatacctgaagtgaagctgctcatggcctcaaactgctgaacgacgcactagagctcaaaacgatcggtcgggtcattacattctctcccacttaaacatacattcatcctcgaacgtgctaagaactacgctagggttgcccgaaatcattatttaacacctcgagcacctactcgtgctaccacaactcagctggtctccctagctcgatcaatccgaagataccctttttcacataggcaaataagccttagagcccaattccaacatccggaattctctgccaggcttgtttccaacatacgctcaccgtatcaatcaccgcatgatgtactagaatatgactgcatacctttgctggattcacaccttgcactgctttattcacagaaccacaataacattctctgagtataatagttgaaattctatgaacctgatactcccattgcacctcatgacatacttaggtcttgctctaactcttacaataccgccacgacggaaatgatgtgtagaaattcataaccaactgctgaatcaacaaatcattgggtctatactcctgacaagaaccatcacctcattctgaaccaaacaatggtcttagctccttaatatacttaatataatcatattgcattgatcctaaatccaatgatcttgtctcacccagtatgaactgctcaggcaataagccaccccagacatgatcaaaagtctcatatgatgacacagtgtgccaataggctatgaactcgaacgtgacaaaaggaaaactaactttggaaggaactactcaactcacgtactaatatggactttccttagaaaatgggaaacaaggaatacaaaaatagcatatagaaaactatactcaacatcacactgttgcggcgtgcaacccgatccaaataacatacccatggcggcgcgccacctgatccacatatagaattcacataaggagatatatatcgagctaaattcctcattacaacaaaataccgaataccggtcacaagcactctaagtgcataataccatccctggggagacatatagtgccataggctacaaaactcaagcacaactgagatgctatatacgatctgaatctcgggagacatcctgctcctataacatcatctctacgcggaacctcaacacataagaaattcaccatgccgtctcacaactcatacaacgccatatatcatttcatgaaatagcaaacgacgaaatactaccccgactacttgtccaaaggagcgtattgctgaaataaacacatctggcctgatatagagcccatattcacatttagatccatccacagacctcaagctgattttgatcacactgaactaggctaataacctttcgaaggttcatagtaactccctttttctcataacacacacgaactaccatcataaccggggcaatcctccaaggtccacaacccaataagtcgagtgccctctaggcataaattctcaaattagtgatattaccacgatcttcatgcttggtttaaatctttaatcaatcaagtgactacatgtcacacttatacaatcttcctgtgagacacgctcccacgaccttccgcactagataacgagtctgcacaactataccaccggtcaaactaatattgtaaagcatatcaagaatccgtaatgaagatgtaagcctccgacacaaatgccgatcttaggtgatgctgaagacaataacagcttactccaaatatccaaatccccttcttgctcatctgagctcgtgacatcctcgccaaataccgaaccacaaacttgatcctcactttaaaatttcataccactcactacatctaacaagccaatatgcgatagtataagaatttcatcataactcctaaaccactattagggtaaatacttcatcacatagaaacgttttacttaactcattccaagagaaccatagctgcacgcgagtgaattctcataaccgtagaacattcaaatccttaagtagttgtctaaaccaccataaccctttcgggatccacctacacataacaaggccataatacttgaaaacttccaaataaaatcaattatggcggacgtcaaacctcgcacgtactgccacaaatcacatatataactttatcacgctgaaggaactgatcacggacgccattatgccaattcaaacatggctaatcaatctaacttcttctaattcatccttaatttgccttagagataataatagctccattccttacatcaccaacctaaatctgcattcatcttgagtaaccccattccacgagaccatattgtctccaaacccatgaactgtttcaaaccctccttgcacgcacattcgcatctttaactaatacacccattctgataattcctctacgaatctgaagtctttttctcattttcctcccaatgccacactgcaagttgaaaatatcatagaacattctgagactcttatcataatcttcaacaaaagctcaattcttaacctttgaatcccctatgactgttattcacatgaacacctatctctacaaagcacccgactgaatcacttcccttgaaatcacctctgtatgaagcataaatccagaattttcccaaagcccgaacatgagccaataaggccaactgtagcacacctttaacaattccttcattccaattacaacttatgttctttcccttagctgtaataactcaccaatatactagtaatcctaaaccttacaaatagacgaccatgcaatccaactgtaggcggtggcactctcccacttagcttaaagccactattacacacctctagaattcaccaagattctttatctcttattgacatgagctcacacaattaaaccgccagattccttgaaatccatccattatcacttcatgaacaccctgaatttccatcaacatgcacatattcgacctcttatcggaatggccagtaaaatccttcgcagaagcttcgccaaccatgagaccgctaacctgctcaaagagaataacccatatgtgtaaatcacttcccaacatcttccaatgttgttgcatggggtacaatcactacgacatcaataacccatcctaagtccgagctcactctctagctgcacaagtccattcacccctcgtggacatcaattaaatatgcggcaacatctttccaattcaaaattatattgtatccttcttcattccaagcagctccattccattatatcaaatctcttgccgcataatagcccacactcccaattaaatccgtaggccccaatcaccaatctttaaaattcccaaatcattccaaactcttcttaaggagcgcattcatcctatcaccaaacccctatgcaactttgccactctcccactttggcggaactaatcgaccacacgacctttgcttcttatacctagccttctagaaattttaaccaccgcttgacactccccacatgtccttcctcattctttgctgctcagttgttgcctcaataaaatttatcttcgtagcacttgaacccacaaatcgctactaactttaaaccttttcggagatcatctttgtcgagccgtcagcattagaaacaccgactcaatcataaaccaccgtaccctacaatatccaacagtcgtttctccaatattatttcacaatatacttccccaagggagaatttcagaagaccataacaccagcgaaattaacacataaaattgaggacgacaacactgcatcgtagataaaaattccaccacgctcaaaattaccaagtcctgttactccatcaccccaaatctggacattcataggccaattgtttttcctccgctggaaattagatatctgatctatgaatcgtgcattgagtaggcttcatttcaaatcattcaccgccccaacacataggaaactatcctaccatcaagttaatattgtgcgataaccaatcatgagcatcatagcaatctgtgcatagcctcaaagctctcaagaatactattactgagccgaaatgacaagatatctttccacaaggcaacgacaatagcccaatcaactattctgggagaaacatcccacaccacatccgtggtaccattaaaattctaaaattctcgatttataacaagctgtttgcgtcgcataagattgagtaggaagaaaataagggcataagcctcaaggaatcaaattgcacaatgaggaatcaagaagggaagtactcctaacagccctgtagcctcccgaagataagtacagacatctccgtaccgatctgcaagactctactagacttgctcatgactcgtgagacctaaggaaacctagtgctttgataccatgttgtcacgacccaaaattcactaagagtcgttatggcgcgggacaccaccgtcaggcaagccaaccacaatttactagcaatttctcattttaattattttgaaatcattttctttaaataaataaatgataaataagaaacttcgctggataaatgaggatgtagagatgagaggtcaactttgacaaaatttaactactgaaaaatcctgtgatcatcccagaacgcgatgtcacaagtacatgagtaatttctaggaaatcatatagtacaacaaccatccggaatacaatattggacagaaagtaaatgcagtaatttgaatgagacattgctggttgcgggtcatctcgggaagcgcagctcacctaagtctccgtatcaaccatgccgctatgcccactaagccactagagatgcatgtgcctgtgcaacaaaaatgcacatcaagtgtagtatgagtacgaaaacaacgtgtgcccaatgagtatcccgtctaatctcgaagaagtagagacgagaggtcgaatttgacatttactagtggtccaataataatatagtgaaaatgtgaggaaaccatgaatttttataaagcaattataaacttgtaaaaccggataggaggtaaacaacatctcaaataaatacagatttccaaggtttactgttccttatgcttatcaactatgtctggccaaggaagacaaatattatcacataacattctcaggcaagcaatacaagcatgcgcatatcatgccgaagtcgtacggcccgatctaacaatatttaaattgtgcactgccgagggtcgaatggcataaactataaatgcatctatttaatctactgaggcgttcagcccgtttcaaatataaacacacacagacagtcaatcaataagtcaacatggaacaattatcaaaagaaaagccaaatctcttttaataatttaagaaaatgaagtttaaatccttttagaaattcatttactaattagatgtgatttaagtaattcagctatcaataagattacaaatagtccaagtatagaatgcttttgggtcctagactacccggacttaaatataatagtagctacacgcggactctcatcacctcgctggggctcgacttaaatgaagctgattgcttcaacagttttcgcatctgcggtcaggggaccacatctatgatcccgcatctgcgaagggaggccgcaactggggaattggataaaagtgctgggaccgcgtatgcggtcttgaagacgcatctgcgaagctgcttctgtggtttggcctggccaactttgggctgtatctacgaggctacaactgcgtatgcattctcgcacctatgatcgacaaacgcaggtgcggttattctagaagcagatgcttcatcacttctccaaattccattttcgttttgttaaccacccggaatccacccgagaccccgggactccaaccaatcataccaaccagtcccaaaacacattacgaacttgctcgaggccttaatcatatgaaaccatgctaaaaccacgaatcgacctccaatccaagctttatgaactttagaatttcaaacttctactttcgatgtttaaacctatcaaatcacgtctgattgacttcaaattttgcacacaattcatattagacattatggacctactccaacttttggaatcggattccgaccccaatataaaaaagtacacttccggtcaaacttctcaagaaccttcaaatttctatctttagcgaaatgactccaaaatgacctgcgaacctccgaattcacttctgatcgtgctcccaactctaaaatcaccatacgaagctactcccagactcgaaatcccaaacagatatcgattacaccgaaatgcacttcaacccaaacttatgaaattcttccaaaattctaacttccacaataggcgccaaatcgctcccgagtcttccaaaacccaatctaaacatacgcccatgtccgaaatcagcatgcgaactttactcgaaaagccaatcttatcgaattctttcaactccaaacttcccggaaatcaatttcgatcgtgcgcacaagtcataatacctaaagtgaagctactcatagcctcaaactattgaacgacgcactagagctcaaaacgaccggtcgggtcattacattattggtggagaaaattgaagaaggatatcgttgcatatgtggctcagtgtttgaattgttagtaggttaagtacgagcatcagaggtctggtggtttgttccagaagatcaagattcctgagtggaattgggagcgtatcactatggactttgttgttagactcccacagactaagaggaagttcgatgtggtgtgggttattgctgataggctgaccaattcagcacattttattcctgtggcagtctcttaatcgtccgagaggttagctgagatctatatccgggaggttgtttgtcttcatggtgtgcccgtgtctatcatttcagaccgaggtacgcagtttacctcacacttctagagagcagttcagcgagacttaggcacatgggttgggttgagcacaacatttcatcctcagacggacgggcgatccgagcggaccattctgtttttggaagatatgctccgagcgtgtgtcattgactttggaggctcgtaggatcagttttttcctttagcagagttttcttacaacaacagctaccagtcaagtatctagatggctccttatgaggatttgtatggtaggcggtgacggtcgttggttggttggtttgagccggaaaacgcttggttgttgaatatggatctggtacaggatgccttggaaaatgttatgatcattcaggataggcttcatatagatcagtatcgataaaaaaagttatgccgaccgtatggtttgagatttggcattcgtggtcagtgagcgggtattgcttcgggcgtcgcctatgaagggcgtgatgagatttgggaagtggggcaagcttagccataggttcattggcccgattgatattcttgatcgagtgggagaggtggcatacagacttgtgttgccgctgagcttaatagtggtgcatcctgtgtttcatgtgtccatatttcggaggtatgacggcgatcaatcccacgtgttagatttcagcattgtccagttggacaaggacttttcttatgaggaggagtcgatagctattctagaccagcatgtttgtcagttgagatcgaaaagttttccttctattcatgttcagtggagaggttagccagttgaggcatcgacctgggtgtccgtgtccgatatgcagagccaatatccccattttttcctccactcaggtacttccctcttctgtccattcggggacgaaaggttgttttagaggtggagaatgtgatgcattctaaggccttaaaaacatctttcagcagcaccttgatttgcgtgtgcagtccgggcgggttgccgggaagccattatgtgaaaatctgtgaaaaatgataaattttgactttaaaatggatttaagttgactttggtcaacatgttggataaacagacctggacccgtgatttgacggtcctggagggtccgtaggaaaatatgggacttggtcgtatgcccgaaatcgaattccgaggtcccaagcccgagaaataaatttttgaaagaattttttttgctcaattaattatgaagtaaagaagagaatttatgtttgaaaccattgttatcgggcccgtattttggtttcggagcccggtacaggtcttatatgtgatttaagatgagtctgtgaaatttggtaagaaacgaacttgaaacgacgtgagtcggaccgtatttgagaaagttggaaaatttaagttcttaagaaatgtcatgattttgatgctaaatttatagttgttgatgttattttggatgatttgaatgcacgagcaagtctatatgatgttttgaggttggtatacatgtttggtttggagccccgagggctcgggtgagttttggataggccacggagtagaattggacttgggaaaattacaggttttcagcttgtatggtcaggtctgcatgcgaagcgtggctcgcaaatgcgacaaatcctcgcaaatgcgaagaatggacctgggcagccttaatcgcaaatgcgactgtcttctcgcaaatgcgatttcgcatttgctaattgtcacgacccggaatttcccaccctcgggagtcgtgatgaaacctacttgtagaagttaggcaagccacgaacttagaaatctttagcgcctactcgtacaagctaggctctttttacaacttatagtaacaagtgataaacatctaaatgatagtggaagaataacattgtttgtcaacatatgtctctacccagaaactggtgtttacaatatccatggactacaatgagtactacatacaacagtttgaaggaagattaacattgtttgtctcggatacatgagataacagaacataataaatgatagaggagacaccgagcctgcgaacgcctgcaaggctacctcggtgtctcggtggactgaaggcaagctccactactgctactgatcaagtgctgctctagtatctgtacaaagtgcagagtgtagtatcagcacaaccgaccatatgtgttggtaagtgtctggcctaaccccggcgaggtagtgacgaggctaggaccagactccagataaacctgtgcagttatataatatatcgcagaaaacaaacatgaataaatagtttaaaaatgggaggtagtacatgctacagggaaatatatcaagaccaacagaaacttaataagatatgaaaggacaactcaatatctacaacactaaaataacaatattgttgcggcacgcaactcgatcccttatcatttaacattgttgtggcgtgcaacctgatccacatatatatagttgttgtagcgtgaaacccgatccaatattgactttgaatctacattgtgttggcactttcaattttcaagtcacgttgttgttttggttaaaggttttaaatgttattatagcttgaaatggtgacactaactgtatatgagttttataacatcatgtatggcatctctgctatagaatatgatttggtatcaaggaatgcatttcatgtctgtttcagattataaataatcagcacttgatcggccttagggggttctcatgaatagctaatttgtttcaagtagttgccgtaaatcccacagttgggccggtgtctttggcccattggcattccgaggcctctcatctgaatcggcctagtttagatttcttctttgtccccgagcccaatctcctaatttacatggccttcgtaattaagcctaggagtcatagaataattgaggcgcgccttgccaaataaaacctcaacatgcatggccctcgtttaattaatcatgtttatccttcaaatttgaggcgtgctgtttagcaaattccacggccctcgcaaagtgcaaacgcgtagttgctttagacgcgctcttaataaaattaccttcctaaactcgggtgcgcattgatgcgacccaaatccaaatctcgatgaagtcgaaatgtgttgacaatcacgggcgcattgattgcgacagggttcgaaacgcgttttcacgacatcgtaattcttataaaataaataatgatataaaagaggttcacaaattaagacaagcctcaccgaacaaaaataaataaatgtggggccctcaatgaatggttatcaaaaatgattagaatttgggagggccatttagcaaacttcacggccttccccaaaataatatcacgttagaatctttaggcgcgattttaattaaattaccttgttaaactcgggtgcgcattgatgcgatccaaatccaaatctcgacgaagttgaaatgtgttgacaaccacgggtgcattgattgcgacgcgattcgaaacgcattttcacgacgttgcaattcttttaaaaataattataataaaagtggttcaaaattaaataaaaggcacataagctagcatgtattaagattagataaaattaaatacaacagttaagcgacctgctagaatcacggaactcgggaatgcctaacaccttctcccgggttaacagaattccttactcggatttctggttcgcagactgtaacagagtcatatttttcctcagttcggggttcaaccagtaacttgggacaccattaatctcgtaagtggcgactctgattctctaataataaatcccgtttcgattgtcctttaattagaaaaactcctttgcgcccttgcagggtgtagtagaaaaggaggtgcgacaactctggcgactctgctggggaccgaacccagaatctctggttcagggttcagaattcgagcttagataaattgttgtattcggttgtatctgatttgcctacatgttttgtgctgaatgtgctaaatgttaccactttaatattacctgaactatatataaactgtgccgatgcccttctctcttcacctctggggatgtgcttacaggttgagactccctattctgttagtgtcataccttgaaataagaaagaggccggacaagttacgaagtcggatggccttttggttcccggtaagttgccccctcctcgactcgagttgtccgctcgggtacacagtctagaacaccgacccaagtttggaacatagaataatgtgacttcatgccggatccctagtagaaacgcttatttgcatcacattgcatttgtcttaggggactcaacacaggggttgggtccgtctaggactatcaacctcaaatgaaaagaccatcctgatgcattctcttgtgctgtgcatttatttgttccgaacctgcatgttgtaatctcgaaaatgttgaaaatttgagaaaaagaaaaaaaaaggaaaaaagagagaaataacagttagggaattaaaaacccaatgcccaaacactgtcgaaactctgccgaaattttgagaaaatgaaaatggaaaatgctttatttctaaatagtctattttactaaaagcaaaagaaaaatagaaaaaaaagtcttttattcttagtttggaaaataggttatttattgtttgttgaaaaagaaaaattgaaaatgaaaaagagtattgttttaaaatagttcggttaaataagtcggttaaaatagttaggcaaccctcatcgggtccaacccttcctttgcaaaaaaaaaacgccaaaaaaaaatgtcaaaatttttatttttcgtcgtaaataagtcgggtgatgccgttttgccaaaaatagccaaatgttcccaaacggaatgtcggaaggctgctttgcaaaacggccatcttggtcaatttttgatttttgaccggttggctttcgcagccttaaaatctttgttcccgaagtgctgaaaggccgcgtttgagaatcgagttcttcatttttaaaaaatatataggtaattttgagtcgaaaatatagatagttttttttttgagtcgaataaaagtttttcttttgcttaatcatcttaataaatgtgaaggacgagcacgatgctaaatgagcccttttcaataatgaccaaaatcctttttgagttgcgattatggtggaatgatttaggctaagaagggcaagacgaagagaaaaaatatttgaaagatctcccggatttatgagactgtcacgacccaaactgaagggccatgactagcacccgaccacacttgccgagcaccaacgtacatttcatctaaccttcattattatcttttaaagctgacgagatcaatataaatggtagacctagatcatggacaaccagcaataaaatatgacagcatgaacatacatagcagggaatgaccagacaatcaagaaactatgtataaggtatgagctaccacgctactatgaaagactatacaacaaaaactagccgacaaggcatactaaactatacatgagccgacacctgtctatgagcctctaaaagaacataagtgttgcaacatatccggaacagggccccgacatacccataatgtctttaacaaaaattgcataccaagaccaaggcaagtccggagaagggatctcgccaatcaccgctgaactggacagtctactgtggtgggggagctgcacctacctgtctatcaggacctgcagcacgacatgcagcgtccacaaataaaaggacgtcagtacgaataaagtactgagtatgtaaggcaaggaaccataaatacgatcagtaatgtaagcaaggatagagaatatacaacctgtaacatcttagtacctctgagggctacttacatgaaatgaatgatacatatgtataaatacataaacctttaaagcattcgcctctatgggcatcatcatcatcatatcgtacccgaccataataggctcggtagaatcatacccggccacgtggagctcggtaaaacccaactgatcagtggttgcacaataggtgccgtacccggccaactatagcgtggctcggtagagtaaaatagatacatatatataatgcatgctcgactcatggaatcatattctaaacctttcggagtgacgtaaggtcggtatcctctgtacacgttattaggactaactcttcactatgaaccttataagaatcaggaagtaccaacaacattgataacataagactaagagaagcaacattaacatcaatcgttccataagagggaaaacaatgtaagtactgctagcttctaagagtagagtatcttggaagatcgttcattacattatgtacaatcggagtcgtgcaaaagaaggaaagggatagcctcacataccttatatatactgccccaatctcaagctatgcaattgtcaaaactccctagtctacaataagagaaacgatactatcgttatcatttaagcgtcataactattatgtatcgaccacaacctattttacgatgaaatggacagcacctaccctatatatatgacctcacaccattcaaaacagtcaccaaacagcccaaacaacatcaataataaacatattgagcctcccaaaatagtccacacatagcctaatcactccatacatacgacgaccaccgtagtcgtgtcaaacaacctgaaaatgttacgaataactatcagcccataaccctaaatatatatggtgtttctccacacccttcctcatccaaaactccacaagatagtagtaaaatacgcagcccaacaacaacacaaaacagtccacaaaacaataacattactaccaagcctttcgatatatatctcacaagttctagcttcaatggcttagccgcaacttggataatcttaaatacatatagagtaagaggttccttacctttatacagaaagaacaactccaatttgaccttaaatttccatgaaatatccctccaatgctgccacaacaacaaaaaagtgaaactagcgatcaattagtgtttttcggcactagaatcactttagaaggcttgaaatcacctaggattgatattaagaacatgagggagtatttatagaacataaaccctttaaaacaacctcccacacgagctgaaacggcacagaaatgagcaacaacaagaagaacaactgacttactagcgccacggaattcccgacacttgatttgtgttgtttgcccttttttgggtcttgaatcttgagagaaccttgagaggatgttcctagggttctaaggtctgaaaatagtgaaaaaaatgacttaaaacgggttggggtcatcctatataggtccaaatatcttaaaccgccttagtgggctccatagagaggtgcttggcgcagtctcgcaaaaacatgaatatctctctactccgagatcgtatcgatgaacgatttaatgatttggaaactagactcatagatatttaattttattggtagatcaccccgtaattccttgtaaattatgagaaaagattagaaacatttgacctaatgtttaagtaaaattatgaacctaagttgcgacaacttttgtcgacttttttttcataactcatttgacttcaagacttatgatacggatattatataattaaaataccttaataaatgacctcttgagtgtattaagcacctctagattacctgaaaatacgagttacaacatccttgattcgtttaacttctaatactggttaatcacccttatacactcttgtatcacttaagaccaataggattgacttcttatcatctcatagataattcctttttggatttatgttaactaatatatggcatgaactaacacatgtggatatgggttgtaacaccctccccccttaggaacattcgtcctcgaatgtaagggtttatggggagtttaaatcatcgtggattccaatggaaatttcctatcaattttcccctataaaatggtcactagcaaaacttgaaagtaattaagcccaacatatggcttcacaagtctacacaaagcattatgcgtatttacattatctacatatcaccattttgtattaaagaggagtattctcaaattattgcttacctcatagagccgtttcaccttccaatgtatcttgtcttccaccagcatccttgttatcttcattctggaataagtaagggtatttagacttcatctcctcttctgtttcccatgtcatttcttccatatttttgttcctccacaatactttgacggaagctacatcttttgttctcagcttgcggacttgccgatctaatatcgccactggcacttcttcatatgataggtcctctgtaacttgtacatctttgatagggacgactcgagaagggtctccaatacattttctcaacatagatacatggaataccgggtggacaaattccaattcggatggcaattctaactcataagcaacctgtccaatccgtcgaagaattttatacggcctgatatacgttggactcagcttacctttcttcccaaaacgcataatacccttcattggtgagatcctcaggaaaacccaatcaccagcctcaaactctagatcacgacgtcggacatcagaataagatttttgcctgctttgtgccgtcctcaatcgctcctgtatcactttcaccttctcaatagcttggtgaatcaaatctgggccatataattctgtttcaccgacttcgaaccatccaactggtgatctacatctcctcccgtatagtgcctcgtatagggccattttaatactggaatggtagctattgttataggcgaattctatgagtggaagatgatcatcccaattccccttaaaatctagaacacatgctcgtagcatatcttccagtgtctgaatggtacgttcagcctgtccgtcagtctgcggatgaaatgcagtgctgagatttacctgtgtgcctaaacgcttctggaaagacctccaaaagttagccgtaaattgagctcctcggtctgatataatacatatgggtacaccatgaagcctaacaatctccttgatatacaacttcgcataatcttcagccgtgtaagttgtctttactggcagaaaatgggcacattttgtaagtcgatcaattatcacccagatggagtcaaacttatgaaaagagcgaggtaatccaataatgaagtccatattaatcacctcccacttccaggtcggaatctctatattttgaagcaatccaccgggtttctgatgttctatctttacttgttgacaattgggacactgggctacaaattctgcaatagacttcttcatattatcccaccaatactgctccttgacatcatgatacatctttgtcgagccgggatggatggaatatcgggattgatgaatctcattcataatcttctctcgcaaccctgccacattaggcacacacaatcggctctggtatctcagtgccccatcttttccgatcccaaaagccatacttttacactgttgaatgctttctcttaatcgtactaaaataggatcttcatattgtcgtgtttttacctcggctaccaaagatgattctgatgtattctgtacagtaacacctccatcatcagagtctaacaatctgattctcatattgtctagctgatgaagctctttaatcaacccccatctacctgcctcaatatgtactaagcttcccattgatttacggctgagagcgtctgccacaacattggctttaccgggatgatacaatatctcgacatcgtagtctttcaataattcaagccacctacgctgcctcaaattcaactctttctgcttgaagatgtattgtaaactcttgtgatctgtgtagatgtcaacatggacaccgtataagtagtgccgccatatcttcaaagcatatattactgcagccaattccaaatcatgggttggataattcttttcatgcttcttcaattgtcttgatgcataagcaatcacattcccacgctgcatcaatacgcaccccaaacctatacctaaggcatcacaatataccacataaccttctgttccttcaggaagagtgagcactggtgtagatgtcaatcgattcttcagctcctgaaaactacgttcacaagtgtcagaccactggaatttggtagctttttgtgttaacttagtcaatggtgatgatatagaggaaaatccttttacaaaccgcctataaaacctgctagccctaggaagctgcggacttctgatggtgttgtaggtctcggccaattctttactgcatcgatcttctgagtgtcgacactaataccctcatcagatatcacatggccaaggaatgctactgagttcagccagaattcacatttggagagcttagcatataacttacgatcctgaagcgtctgtaatactatccgcaagtggcccacgtgttccgcctccgaacgagaatacactagaatgtcatcaatgaatacaatcacgaacacatcaagatagggcctgaatatagtattcatgagatccataaaagctgctggggcatttgttagcccgaacgacatcaccaagaactcaaagtgcccatatcttgtccggaaggccatctttggaatatgtttctccctaacccttacctgatgataccctgaacgtaaatcaatcttggagaaatacttggcaccctggagttggtcaaacaggtcatcaattcttggaagtggatacttattctttatagtagacttattcaactgtcgatagtcgatacacatccgtaatgacccgtctttcttcaacacgaataggactggtgcaccccaaggtgaagtgctaggcctaataaagaccttatctaggaagtccttcaactacaccttcaactcttgcaactctgccggggccattctgtatggaggaatagagatcagttgagtgtcacgcaacacatcaatgctaaactcaatctccctttcaggaggaaggcctgggagttcatctgggaaaacatctaggaattcgttgaccacagggattgattgtaaagtaggcggtttcgcctccgcatccctaacgcgaacgagatgataaatgtagccttttgagatcattttccttgccttaagatatgaaataaacctacctttcggtgtagcaatgttccctttccattcaatgatgggttcacccggaaattggaacctaaccatcttcgtatgacagtcaacatttgcatagcatgaggccaaccagtccattcctattatcacatcaaaatcaaccatttctaactcaaataaatttgccgaggtttgaagactacaaatcatcacagtgcaacctctatatacccttctagcaatcacagaatctcctatcggagtagataccgcgaggggtttacttatcaattcaggttcaatgccaaacttattagccacaaagggtgtaacatatgataatgtagatcccggatcaatcagcgcatatacatcataagaaaacacagatataatacctataagaacatctggagacgactcgagatcctatcgacctactagagcataggttcgattttgagcaccactcgaactcggcactgcacctctacccctaccacgacctgtcgactgctgaaaaccccgtgctggaggtcgaactgatgaggaagaaccagacacagatccagttggctgagccataccatcacctcctctattaggacaatcccgcatcatatggacaggctgcccgcacgaatagcatgcatcagaacctcgacgacacagtccaaagtgggccttgccgcactgatcacaatgtggtgttgggggtctcatctgactagtatccctgtgatgttgcgagccagatgcccgcgaactctgacctggaccagaataggatcgatcatatcgaggcctctgaaactgtggaggagcattagctacaagtggcgccgaactcctcgaaaactgtggcctgatacggcctctgaagtcattagaataccctgcaaatctcgcccacttatgctggcctctatcctgctccctaactgccctctactggcgcttacgatcctctagggtctgggcataagcttgaatacgggaaatatccatgccctctaccaaggaggctgtcgtacactcatttattagatgtggtcccaacccattcacgaacatatgcaccctatcactcatctcggccaccatatggggagcataccttgccaaagaatcaaactgcatactgtactctcgcacactcatattaccttgtctaaggttcaagaacttatcagctctagctcgtcgtatctcaactggcaagtagtgacgaagaaaggcctcagaaaattccttccacacagctggaggagggttcggacccctggatctctcccaactatcataccagagaactgctaaatcccgtagccgataagaagccaactctactgcctctgtatcactaacatgcataacccgaagtgtacgataaacctggtcaataaaagtctgtgggtcctccttggggtctgatccggtaaacactggagggtctaaattaataaaatcccgaactcttgtactaactggtttctcagcagcacctgtattctgcctctgagcctgagcagctaccaagctagtaaataactgcaaagcactctgcatatcctggtctggagtgctagacggaggaactggaggtgctgggtgccttctaataccctctggaggagatggagtagataaggtatgagagggcatctcactttgagcctcactttgtcctgctctgacttggggaacctgactggtaccctctcccgctgctgtatcaagccgtctactaatcgtttgcttcctagtcgaaggcatcactggaaaaaaacaaggtgaatattagagacgaacacttacgactcaactctacgcacgatctagattcaggaagaaggtaacaaccctagatgtcatgtagcctcctgattataaatgtggcgcgctacacatccataatcaagactctactagacacgactcatagacaacccctaggacagacttgcttcgataccaagtttgtcacgacccaaactgaagggccatgactagcacccgaccacacttgccgagcaccaacgtacatttcatctaaccttcattattatcttttaaggctgacgagatcaatataaatggtagacctagatcatggacaaccaacaataaaatatgacggcatgaacatacatagcaggggatgaccagacaatcaagaaactatgtataaggtatgagctaccacgctactatgaaagactatacaacaaaaactagccgacaaggcatactaaactatacatgagccgacacctgtctacgagcctctaaaagaacataagtgttgcaacatagccggaacagggccccgacatacccataatgtctataacaaaaattgcataccaagaccaaggcaagtctggagaagggatctcgccaatcaccgctgaactggacagtctactgtggtgggggagctgcacctacctgtctatcaggacctgcagcacgacatgcagcgtccacaaataaaaggacgtcagtacgaataaagtactgagtatgtaaggcaaggaaccataaatacgatcagtaatgtaagcaaggatagagaatatacaacctgtaacatcttagtacctctgagggctacttacatgaaatgcatgatacatatgtataaatacataaacctttaaagcattcgcctctatgggcatcatcatcatcataacgtacgcgaccataataggctcggtagaatcatacccggccacgtggagctcggtaaaacccaactgatcagtggttgcacaataggtgtcgtacccggccaactatagcgtggctcggtagagtaaaatagatacatatatataatgctcgactcatggaatcacattctaaacctttcggagtgacgtaaggtcggtatcctctgtacacgttattatgactaactcttcactatgaaccttataagaatcaggaagtaccaacaacattgataacataagactaagagaagcaacattaacatcaatcgttccataagagggaaaacaatgtaagtactgctagcttctaagagtagagtatcttggaagatcgttcattacattatgtacaatcggagtcgtgcaaaagaaggaaagggatagcctcacataccttgtatatactgccccaatctcaagctatgcaattgtcaaaactccttagtctacaataagagaaacgatactatcgttatcatttaagcgtcataactattatgtatcgaccacaacctattttacgatgaaatggacagcacctcccctatatatatgacctcacaccattcaaaacagtcaccaaacagcccaaacaacatcaataataaacatattgagcctcccaaaatagtccacacatagcctaatcactccatacatacgacgaccaccgtagtcgtgtcaaacaacctggaaatgttacgaataactatcagcccataaccctaaatatatatggtgtttctccacacccttcctcatccaaaactccacaagatagtagtaaaatacgcagcccaacaacaacacaaaatagtccacaaaacaataacattactaccaagcctttcgatatatatctcacaagttctagctgcaatggcttagccgcaacttggataatcttaaatacatatagagtaagaggttccttacctttatactgaaagaacaactccaatttgaccttaaatttccatgaaatatccctccaatgctgccacaacaacaaaaaagtgaaactagcgatcaattagtgtttttcggcactagaatcactttagaagtcttgaaatcacctaggattgatattaagaacatgagtgagtatttacagaacataaaccctttaaaacaacctcccacacgagctgaaacggcacagaaatgagcaacaacaagaagaacaagagacttactagcgccacggaattcccgacacttgatttgtgttgtttgccctttttttgggtcttgaatcttgagagaaccttgagaggatgttcctagggttctaaggtctgaaaatagtgaaaaaaatgacttaaaacgggttggggtcatcctatataggtccaaatatcttaaaccaccttagtgggctccatagagaggtgcttggcgcagtctcgcaaaaacatgaatatctctctactccgagatcgtatcgatgaacggtttaatgatttggaaactagactcatagatatttaattttcttggtatatcaccccgtaattccttgtaaattatgagaaaagattagaaacatttgacctaatgtttaagtaaaattatgaacctaagttgcgacaacttttgtcgacttttgtttcataactcgtttgacttcaagacttatgatacggatattatataattaaaataccttaataaatgacctcttgagtgtattaagcaccgttagattacctgaaaatacgagttacaacatccttgattcgtttaacttctaatactagttaatcacccttatacactcttgtatcacttaagaccaataggattgacttcttatcatctcaaagataattcctttttggatttatgttaactaatatatggcatgaactaacacatgtggatatgggttgtaacagagacattcagcctcgggggatattatcagggcattggtcgcttggtgggattcggcacataatgtatttcctttctcggacattgagctcaccccgacattggaagaaataacggcgtacatcggaagtgatcaagctccattgaggttcaaatacttaattgctcccagggccattattgtacatcggtttttagattccttgaaaataccccgaacagttcatcatccagatttggcaaaaggtttatgcagtttccgctacatatatgatagatatggccacgtgggcagattcaataatccagactttaagctatgcagtagaagtaaccgacaaaaatgggaggaacacagacgggtggctttcataatagcctttttgggcctcatagtatttccaaggaaagatggagatattgatttgaaagtagctggggtcgtctgtaccttgcaaaccatggggaaaagcactttagcacctatgatcgtggctgacatcttccgggctctcacggcttgcaaagctgggggaaatttttttgaaggatgtaacttgttgttacaaatgtggatgactgagcatttgtgcccccgctctcagctcttgagttacggttcattcgagaaaacttgtataggagaatttcacacaagaatcaagggggctagtctacctgaaggagtcacggcttggacatcattattgcggaccctcactgccattcaaatacagtgggtgctcgaatggttgcctgtcgaagaactcatatatatgccagcggccaggccgcattttctgttgatgggactcaaaagcatccagccctatgcaccatatcgggttctgatgtaactcaggaggtaccaagtagtaccaagagatgaagatctgagtacccaagtggtcgaaattagtcctgatagtcggtttcccgaagaagaggttcgccaaatctggagtgagtatcaacatttgatggcaaacacttatgtgtcagataaggctaaaggggaagttgccccagggtatcatgattggttcagaggcgacgtggcatgtgggagaccgggtaaaagacctcatctcgaagattttgccgagtcgtcccaagagcagtgggactggttagcaaaggaagaaggctatcgagttgagattggtaaactgaagcagcaagttgagagtctgaaattcgagaacagtgtacaggttgccgcggatcaaggtgagaataacagactggctcgagaaaacgaagcgcttagggcccgaatccagtaattgaggataaccgtcgataagcaaccaaggagccgatcagatgagcaactaataaaaaggctggaaaatgaagtcagggaatggcaggatgaattagaaaaatccgagaatatcgtggcagagcttaaagcacagtgggatacaagaacagaggagcgtcgccagtacttgaatcagttcaaaacggaccatgagaaaactgttgccgatttaaagagaaaagtggttgcccttgatggtaaagcggttagacaggctagagattttggaattgaaagtggacattgttacgacttgtttgcccaaatggaggtagaagtgcagcagttgcaagatcaacacctgcaagattctcgagctttaaagacgtgcagcgatcagataagaagcttgtttgtagaaaagaagcaaacaaaagacaggattagagccattgctcataccattttcaggagatgccgggtttgtgaagacatgacccatactacttttgtctccgcagtgatgatctatgtaaaacgaaccatgactgaattagagcagcttgaaagggatttggatcctaggaccgcggcgaggccgaacgacgccctgcggacacctaagtttgaagcattagagtatgcataggccatgtctgtagttttctaccttttgagtctgtcttttgtctgtctgttatcttttcaggtcaagtatgtttgcagtcttagagtctgtgtttgcttttaatttgcgtctgttagtttcattccgaaaaatgtttattttgtaatagtttgttttagtaatgaaaattgaaaatttcaaaaataattcttatttccaccctttatttttgcatatatatttcacgaactacgtttggtctgattcgtgcggggtcacgatacgtaggcaatctccataggattcgaccgtaatcgtaacaacaaaatataagaaagagagagagataaaagaagggagcggaaaaagagaaaaagaaagaaaagagcggaaaaacaaaaagagaaagtgaaagcaagaaatgagcagaaacacaagagaggaagaaataaaagaaagaaaagagcacaagagagggataaggtgagaaatttgaaagaaaggtaaaatgaaaaaaggaacgaagtgccgggatgacgcaaacgcataatagaaatgattaactgtataagtgcattcataccaacgtgcggttgtcaaatctgtgaagacttaatcgctaacaaagtggttgtataaatgtgtgagttcaggcaggtggttagttgattggcagttctagcaacccacccgtacaacacccggtcgaaagataaaataaacatgacaggacaggactcggatatcagtctcgtggacccttcaaatgaagttgaggtaacagatgtgggtgctatgaaagaagagatgaggaaactaaaagcacaaatggccgaaatgtatcgagcatggtctcagggacatccggcaccactataccccactaatccatcttacatcccacctctggctcaggctcaggagcccatcactccccacgcatattcaactctcccctattacacccagggctatggtactacttcatatgcccctccagctccaccacccaaacagaaccctcccccacccatggttccagtctttgtggcacctcccccagccccattacatagatcgtccagtgagccgctattccaagctcacgacacccaatattaccctctcgaacccacttttaaaacgcctgagccatatacctatactccccattttgaaatcccagaagaagttgagaaaccggttaagaatgcagaacaggaggaagtgattcgtaaagtcaaaagcctggagcaatccttcaggaacatgcatggtttaggcaaccgagtcagtgttgcatacaaagatttgtgccctttccctgatgttcagttgcctgcggggtttaaaatgccgaagtttgacttgtatgaggggcacggtgatccagtagcccatctgcatggcttttgtagcaagatgagaggtgttggggggtagtatgaattgttgatagcctatttcggtcaaagtttgagcgggtccgcgctagaatggtacacgagacaggaccccggccgatggtatacatgggatgatttggcacaagcattcattggccattttcagtataaccttgagattgtccccgatcgtctgtcattgttgaagctggaaaagaagcccggggaaagttttagagagtttggcttccgctggagggaacaagcagcaagggttgatcctccgatgagggacagtgagatggtagattacttcttgcaaacattggagcccacctattttggtcatctagtgacatctgtcggaaaatcgtttaatgaagtggtaaagatgggagtcatgattgaagagggattgaagtctaacaagatcttgagctactcggcattgaaagcaaccacccaggccatccaaagtggtactggtggtgggcttggaaagaagaagaaggaagaagttgctacgattgaaactagtacttggtccaggcccaataaccctccaccctactacaaccaacccagaccccaccacccaaactaccaatataccccatatggcccaccgcaaccctactatccaccactagaaccacacttttctatccaccacgcccagacatacactcagcctccggtgcacttgtaatggcgcacaccgactccccaaaacatacatccaccaccacaaaacacctatccaccccccagggcaaacagaccaggaaccagcttccgcccaaaccaagcttttagaagtgagaaggccccaaacagaaaaacatttactccgctgggggaatcttacaccactcacttccatagattgaaacagttgggaatgttgaccccaattgagtccaaagcaccaaatccctttcctagaaatttggaccattttgttagctgcgagtattgctcagggatgccggggcacgatactgaaaaatgttggaagttgaaaaacgcggtacaagaactcattgataatcgccgtattgaagtacaggctccagaggccccaaacatcaatcaaaacccgttaccagcgcattatgaagccaatataatcgaactgatacataaggggatagagcctaaaaaaaccctcgcagacggtcatgttgatccgttctacggaagacaaggtcaaagaaaagacagttagcataaggccagcggttcagctaaaagctataaaagataagccagtgttggtaatggaaaaaggaccatttgttgctgcaaaaaagccagagccagtcaagttagtggtaccggggtcatcatctgtacccgtggttgttgtgaaagggtcctacatagaaccagttgtcataaagccgatagtccaattacccgtggtttatagcaaagccgtactgtggaaatatgacaaggtagtgttgacataaaaaggaaaggaaattgaggaagagagttgtgaagcacaaggactaactcggtcaggacgctgttttgcgcccgaagagttgagaagggctatgggcgctaaggataatccagtgttagtaaaaaaggctgtgacagaagaagaggcagaagagtttctgaaaaagatgaaagtgcaagattattccagtgttgaacaattgagaaaaacaccagcccagatctcgttgttgtcattattgatccattctgacgagcattgccaagctttgatgaagatattgaatgaagctcatgtacctgacaaaatttcagtgaaccatctggagacaattgccaacaaaatctttgaggtaaacagggtaacattttctgatgatgaattgcctgtggaaggcacagaacacaataaagctctctacctgacggtcaagtgtgaagattcaatggttattcgggtgttgatcgataacgggtcaagtgataatatttgtacgttgtccacattgaacaagttgaagattgatgacgatagaatccgtaaaaatagtatttgtgtttgagggttcgacagagggggaacaaacacagtgggggatattataatcgaattgactattggccccgtcgagttcactatggaatttcaggtgttagatgctacagtgtcctacaatcttttgttgggtcgaccatggatccacgcggccaaagcagtgccttccacactgcaccaaatggtcaagttcgagtgggatagacaagaaatcgtgttatatggagaagatcccacatgcgccatgaatgatgccattgtgccctttatagaaactgaagatgataagggaccatgggtttatcaggtcttcgacacggtcccggtgaacagagtgcccgagggtaaaagcatcccatgtcctaacggcatgggttcaaaccaacaacggcagatgttagaagggctcgtaaattgaaaaagaaagcttgggttcttcccaaaccgattccacgcttgtccaggtctttcgtcaggccgggtagcaagaagcagtcattggctaaggtgttgggtccactgattggtgcagaggggaacttggataaggtgttcgagagggtatttgctgaagtgaacatggttgaggccggggaagggtcaagcatagcagatatacagtacatcggaccgcatgctaacatcaacaattgggaagctactcctcttccaattcggtgggagtcgtggtagtggattttgttttccttttgtcacctggattattccagggtttgtaattcagttgctatgtttcgtccgtttggatgagttaaaaccctgttatctttacattcaatgaaatgcaattttcttcattcctaattttgtttccattttttttcttttcttttgtacagttctttttatgatgatatcaatgatatgacatgcataaggaatcttcggcccagttttaaaagccaatctagctcagaaataataatacaagaaattgagtgtgatgatggggtggattgtaacgacgatgaggcttatgaggaaattagtaaagaattaagtctctttgaagaaaaacccaaacctaacctaaatgacacagaagcagttaatctaggggaccaagacaatgtatgggaaacgaaagtaagtattcatctggagccacaactcaaggaggagataattagagtattgcatgagtgcaaacatgtttttgcatggtcgtatgataatatgccaggtctaaacaccgattttgtggttcacaaattgcccattgatccagcactccctcctgtcaagcagaagttgataaagttcaaaacgaacataagtgtgaagatcaaagaggaaattaccaagaaatttgacgcaaaggtcattcaggttacacggtatcccacttggttagctaacgttgtgcatgtgccgaagaaagatggcaagaccagggtgtgtgtcgattatcgagatcataacaaggcgagtccaaaagacaatttcccactgcccacatccatatactgattgacaattgtgccaaacatgatattggttcttttgtggattgttacgcgggttatcatcaaattctaatggacgaggaagatgcagaaaagacggcattcatcacgccttggggaacgtattgttatcgggtcatgccgttcggtttgaaaaacgctggggcaacttatatgagggccatgaaaacaatattccatgatatgatacacaaagaaatcgaggtgtacgtggatgatgtgatcgtgaagtctagacagcagtccgaccatgtcagagatttgagaaagttctttcaaaggcttcgcaggtacaatcgtaagctcaatcctgtaaagtgtgctttcggggagccatctgggaagttgttggagtttatagtcagctggcggggtattgaattagacccgtcgaagatcaaagctattcaggaattgccacctccaagaaacaaaactgaggtgatgagtttgttaggaagattgaactatatcagtaggttcattgctcagatcacgacaacttgtgagccgattttcaaattgttgaagaaagacatcgcggtcaaatggactgatgaatgtcaggaggcttttgataagataaaggggtatttgtcgagcccacctgtgctggtcccgccagaaccagggaggcctttgattctatatctgacggttttggataattcattcagctgtgtactagggcagcacgatgttatgggtagaaaggagcaggctatctactatctcagcaagaagttcacatcttacgaggttaagtatactcatctggagaggacatgttgcgccctaacttgggtggcacagaagttgaaacattatttgtcatcctacactacttacctcatatctcgcttggaccggttgaagtatattttttagaagcctattcctacagggaggcttgaaaagtggcagatcctgcttacagagttcgacattatctatgtgacagggactgcgatgaaagcacaggcactagccgaccatttggctgagaaccacgtcgatgaagattacgaacctttgaaaacttatttccctgatgaagaggtgatgcacattgatgaattggaacaagctgagaagtcgggatggaaacttttctttgatggggttgcaaatatgaaaggcgtgagaataggagtggtgcttatttctgaaacaggtcagcattacccttttacagctcggcttcgtttctactgtacaaacaacatggcagaatatgaggcgtgtatattgggattgagattagctgtagatatgggtgtacgggaagtcttggtcatgggtgactcggacctactgatacaccaaattcagggagaatgggaaacacgagatttaaagcttataccgtaccgataatgtctgcatgagctttgccagcggtttcaggctatagagttcaagcacattccaaggattcataatgaggttgtcgactctttggctactttggcgtcgatgttgcatcatccagacaaggcttatgttgacccattgcagatttaggtacgcgatcagcatgcttactgtagtatgatagaagaggaaatcgacggtgagtcgtggttccatgatatcaaagagtacatcaggatgggagtatatccgatacaagccaccggtgatcagaaaagaatgattcggcgattggcaagcgggtttttctttagtggaggagtgttgtacaaaagaactcctgacctcgggttgttgagatgcatggacgcaagacatgccacatctatcataactgaggtacatttcggagtttgtggaccgcatatgagtgggtacgttctagcaaaaaagattctccgagcaggttattattggctcactatggagcgggattgtatcagttttgtgcgtaaatgtcatcagtgccaagtgcatggagatttgattcattctccaccatcagaactacatacgatgtccgcaccatggccttttgttgcatggggcatggatgttattgggccaattgatccggcagcgtcaaatgggcacaggtttattctggtagctatagactattttaccaaatgggtggaagctaagacgttcaagtatgtgactaagaaagctgtggtcgactttgtgcactcaaatatcatctgtcggtttgggattccgaaggtactcatcacggataatggggctaatcttaatagtcatttgatgaaggagacatgtgagcagtttaagattacccataggcattctactccataccgtcccaaggctaatgggacggttgaagcagccaataagaatataaagaaaatactccgaaagatggttgaagggtctagacagtggcatgagaaattacctttttcattgttagggtaccgcaacaccgttcgtacctcagtgggggtgactccttattcattggtgtatggcaccgaggcagtaatacctgcagatgtggaaatcccgtctctgcgaatcattgcggaggctgagatcgatgatgatgaatgggtgaaaagtcgccttgagcagttgagtttgattgacgaaaagagattggcatcagtgtgtcatggtcaactgtaccaacgaagaatggcaagagcatacaacaagaaagtgcgtccaaggaaattcgaagtcggacagttattactgaggcggattttgcctcattgggatgaagcaaaaggaaaatattccccaaactggcagggaccatttgtagtaaccagagtgttgtctaacggggcattgtatttgacagacgtagaaggaaaatgtatagaaatggccattaattctgatgcggtcaagagatattatgtatgatttctttatttctgaatgtatctgtttgtatttggcatatcttaaagattgaaatgacgaagacgttttgtcctgctatccaaatacttttatcctttgtcatcccctttgagccttacttatgtttcatacccctctttcggaatcaatgacactatcagagaacacaggtgccgaacataaaagaaagaaaataaaagcaaagtaaaaagaaaagtaaaggaaagaaaggaaaaagaaaaaaagaagaagaaaagaagagaaaggaaaaatgaaagggaaggaaaagagaaagagaagaaatgaaaaaagaaagaaaaggaaagaaagaaaaacacaacaacgaaggtaattatgatacagtgaactacgtttgacttgatcccgaaagggtacgtaggcagccttactccgaggttcagtcataccaaaataaaaatccaaaaatccccaagcaagaaactggggcagaagttgtgattgttgtgaacagttggattccgaaagttataatttgaacccatttgaattattttgagccttttatacctttctttctaacccaatccaaaagcctacattactctccaaagaaagaccttctgatcaatttttgagaaatgccaagtcgagcaggtagcggtaattcgtggcagtggcaacactctggttcaagcaagaagaacaaaagataaaaatgagagagtcttatgggtgaaaaccctcacgggcaccgtaaggcgacgggagctgagagaaaataaaatgagagagtcttagtggtgaaaaccttcacgggcacctcaaggcgaaagtgagttgagaaatggcaaactaagaaaggtctgttgatggaaaactgtttcgaggcaccgcaggatgaacaaggttaaggtctgcttaattcaaacaattgatggaagtcctaggcaacgaggtatggcaattgagagttgtttagttggatcggctgggccgattagtccggaatgcatgtcatgaccattggtgccagctgttccggtcagataagtttcttttcttcacttcatttttagtagtcatccggttttctagattcttcttatccctaacccgtaaaaccattgcatttcattctctttgggggggggggttgtttgtctaaatgttctaatgtcagttatgttcaaacgcaagtgggaaaggatttcaaggctcgctaccagcttccaaaattgtaaggcacaacgtggtcagagcatatcaaaaacaacatgatgtcaagtggaatacagggaattaacggaaatttcatcagtggaatgattgggaaaggtcgtgagaaatgcaaaggttcaaacaaaagggttagaaaagcgaaataacagcatgggtgtaaaacatttaggtcgccagaggttggggaatttaaaagttggttagaaaatcaaacggttcagggtcagtgcatggaagtcagtcaacacaaagcaatgcaggggaaggatttttcagcaagaatgccatcaactaaccaccattttaaactaacagaattttctttgattggaacgggggcagaaagttggttgttcaggaggaattctccataaagggaaagcaagcagtaatcaagtttgaccgcaaagtgcggtttgattaaatacaagataatcatgaatagcgtaggggaatataatttggttgcaaagtttgcatgtttaggataaaatgcaagttgtcaggaccttccttgataataggacataattcaaatacccggataagataacatggtatagtgagaagtaacaccttaggttcataattgtttggagttgacaggatcttcctggataaaatgatgtagtttaaacccttgtagatagcacgatgtagtgagagtaataccttaggtttgtaattattacccccctggataataggatttagctttcaattcttaataatatgtgataatatgattcagcttaacactcacccatacacccagcttccaaactggggcagaaaaattttcgttggttgattattttgttgaagtcaggagtccgcctggagaacagagacatacttttcaagtttggtgtcatgagtccgcctgaaggacggaaacatatagtttaaattttaaaagtcaggagtccgcctggagaacagagacatacaatttaagttttagcgatcaggagcccgcctgaagaacaaaggtgacacaatgcaagttttagttttcaatcaatttctttgtctattttgaagtcaggagtccgcctggagaacagagacatacagtttaaattttagaagtcaggagtccgcctggagaacagagacatgcacttcaaatttcggtagtcaggagtccgcctggagaacagagacatacaatttaagttttagcaatcaggaacccgcctaaagaacagaggtgacacaatgcaagttttagttttcaatcaatttctttgcctattttgaagtcaggagtccgcctggagaacagagacatgcatttcaaattttagcagtcaggagcccgcctggagaatggaggtatttatattttaagttgtagttgaagtcgggagcccgcctgtatgacagaggagcccgcctggataatagagtaatacgtttcaatttcaagttaagcagttaggagcccgcctggataatagaggaatacattcaatttcaagttcagcagtcaggaacccgcatggataatagaggaatacattaaatttcaagttcagcaatcaggaacccgcctgaagaacagaggaatacactcaaatccaagattatttaagttcagtaatttggaaagaaatgataacatctcagttcacgatttgaagtaacaatagtgagtttcacaacaaggcaacaaggcaagaaggaagtgcaagatgcaagtttgaagactttagataagacttttgtaattcacagttcatagcttagtctagcttcttttattttaccatggtgtaataaggaaggtcagcaagcagtagtagtagcaatcgcagtgaaatcacagctcctggtatcccagctaccagacactcccgaactacactaacctaattcctgtttagcccaggatatgtaggcaacctctgaaacagggtgcggtcaaaacttttcaaaatgtttcacgacggaatatttgaacgggcaaaaatcgctcgtatttgctcacttatctttgcacgaaaacatttcatgtttccgagcaaagaggggcagctgtgagcacgtgatttttgccctgtatatgaataattcccaaaaattcgaacaaaataatttttgtgcattttggtattattttatgatattggttgcgttttatgtgtgcatgttaattcatacaaaaatatgcattttcatttagcatataatttcatacttttaggatcaattaggggttggtttattttagaaccaagcatgaaaaattacaaaatagtttacttttgaatttttattttttaagtcgtgaatttggcgtaaaacaggtttagatagttttagaatttaattagtttagctttggaatattaggactctattgtaaattaaaaaatataaataataaaataatataaaaatagtataaaatggaaaacaaaagtaaataataagcaagcaaactcatcctacctttcctctcaaaccctaatcccagccgcccccaaacccctcgccggcgtgaagcgcaacgtacgtcgttcaaccccaaattaacaccatagatcccccatgaatccctctttttattcctactattggtttccctcgaatatttccagagctcgtcgaatccccgattgaagtttttcggccaagtcgcaaactcatcctaatcggcccaaaatcacaccacaccatccccagacttccctcaacccaaatccatgaccatcttctttcgaatctcggtgaagcggcttgaatttcagatctaagaatttctgtccaaaaccctaacccaaaatctttgtgattttggaccgtaatatctttaaccatgtggtctcttgtaaaaacacatggttagggatgttatgtgtcaaaaatctggaaaggttcggacgtcagcaatgggccagagtttctcgcgcttcagtgagctttcttgtttctttttacttgtatggttgaagttttagttagttttgatttcattaagtgttctgttaatcttacgatttatttttgtgtattagtatagtgtaaattttctttgttccttgttccttgttccatctgttttaatcagtaaatcgtcttcgcatttttagtttagtttgatgcatgtgtcatttgttagttaatcatagtcttaatttcagaatcggcataattgattagttttggattgaataccattttgtccattaatgttagctagatgtttaggttgatttcaattgctttttagttctgaatttaatgttcgaatggtcaattgtgagattattggttaaaagttattttaatttcatttaatgttgattgatcctggtctcctagtttttctaagttgtttgggtttgggtgattgaataattgggattggttagttcaattggttaatttctgagttctaattaatcaatcctagttagttttgaattaatttaggggattggttatagctgttgagaatgtgggtagaatcagtaacttggagaagctttcagtggtagtttaggcatggaaaggggtaattctgataagaatagtaatttcaaagtaggggtaagggtagtataggtattgtgggggtagaagagcatcctagggccttatacaagggtactttagtgtaggtgttagcacaatagagggatttacttgttgggcaagtcaaaaataaagggactaaactgaaaatgagggagggactaaaaagaaacccaaaatctgattgaccctcttgtatcacctacaaaaaggcatcaagtgccttgaggaaggggattcaactttcagccataaaaatcacccctcacaaacattctcttcatttttttaagatctgaaaattgaaatttaaaacttcaaaagccaaaaaatacattattctaatagaaaatcaaaaaaaaaaataggttagtattccattggaattttcatttttaaactcccagtagtgtttgagttcaaggcctggtagttgcatttgctgatttcgaagggttgtaaatatcactgagctggatttcgattgaatctggttttgactggaaatagaaggaatttggtggataattgtcaaggttatttggtccattctgattttggtttgagttgatttctcagtggtttcaaatttcattctgggctgtgtctcaatttcctgggctgtgtattgttgttgtttgatcatctcttggtctactgttgtttgaactgctgctgactcactcttctccttcattattcttcaaatctccaggtacaatactcaaacctgacatggaattgaatattgattggcttgcacgaagctgttggaaattcaagttgaaattcaattaactatctcaagtttgatgttctttaatacttttagtatacatgattaagtgcttcagttctgtatatttctatttttggtttgtatcgagtgctagtgcatgctaagggcttaggttgatttcgttgcttggatctattgtataatttcagaatactgggtgttttaataccgttcgaactcaagtgtaggaattgattgcttttaagctttcaaatggtgatcatgttaagcttagttgagtggcttttgcgtttctgactttgaactacattggcactttcaattttgaagtcatgttgttgttttggttaaaggttttaaatgctattatagcttgaaatggtgacacaaactgtatatgagttttataacatcatgtatggcatctctgctatagaatatgatttggtatcaaggaatgcatttcatgtctgtttcagattataaataatcagcacttgatcggccttagggggttctcatgaatagctaatttgtttcaagtagttgtcgtaaatcccacagttgggccggtgtctttggcttattggcgttccgaggcctctcatcggaatcagcctagtttagatttcttctttgtccccgagcccaatctcctaatttacatggccttcgtaattaacctaggagtcatagaataattgaggcgcgccatggcaaataaaacctcaacatgcatggccctcgtttaattaatcatgtttatccttaaaatttgaggcgtgccatttagcaaattccacggtcctcgcaaagtgaaaacgcatagttgctttagacgcgctcttaataaaattacctttctaaactcgggtgcgcattgatgcgacccaaatccaaatctcgatgaagtcgaaatgtgttgacaatcacgggcgcattgattgcgacagggttctaaacacgttttcacgacatcgtaattcttataaaataaataatgatagaaaagaggttcacaaattaagacaagcctcaccgaacaaaaataaataaatgtggggccctcaatgaatggttataaaaaatgattagaatttgggatggccatttagcaaacttcacggccttccccaaaataatattacgttagaatctttaggtgcgattttaattaaattaccttcttaaactcgggtgcgcattgatgcgatccaaatccaaatctggacgaagtcgaaatgtgttgacaaccacaggtgcattgattgcgacgcgatttaaaacgcattttcacgacgttgcaattcttttaaaaataattataataaaagtggttcaaaattaaataaaaggcacataagctagcatgtattaagatcagataaaattaaatacaacggttaagcgaccgtgctagaaccacggaactcgggaatgccttacaccttctcccgggttaatagaattccttactcggatttctggttcgcagactgtaacagagtcatatttttcctcggttcggggttcaatcggtgacttgggacaccattaatctcccaagtggcgactctgattctctaataataaatcctgttccgattgtcctttaattggaaaaactcatttgcgcccttgcagggtgtagtaaaaaaggaggtgcgacaaggttaagtacactcacctggaaaggatatgttacgccctaacttgggtggcacagaaattgaaacattatttgtcatcctacactacttacctcatttcacgcttggatctatttaagtatttctttcaaaagcctatgccgacaggtagacttgcgaagtggcagattttgctcacagagtttgacataatctatgtgactcggacagcgatgaaagctcaaacattggccgatcatttaaccgagaacccggtcgatgaagagtatgagccactgaggacttattttcccgatgaggaggtgatgcatattgacgagctagaacaggccgaaaaaccaggttagaaacttttctttgatggggctgctaacctaaaaggagtgggataggagtcgtgcttatttctgaaacagggcatcactatcctgttacagctcaacttcatttttattgtaccaacaatatggctgagtacgaaatatgcattttgggtttaagtttagctacagacatgggtgtccaggaagtcttggtcttgggagactcagatcttctggtacaccaaattcaaggagaatgggaaacacgacatttgaagctcataccataccaacaatgtttgcatgatctttgttaacggtttcgatcactggagtttaggcatattcttagggtccataatgaggtcgccgatgctttggctaccctagcgtcaatgttgcaccatccagacaaagcctatgtcgatccttcgcacattcaagtacgagatcagcatgcttactgcaacatgattgaagaagaacttgatggcgaaccatggttccatgatatcaaggaatacatcagaatggggatatacccagtgcaagccacgtgggaccaaaagagaacaattcgacggttagcaagtggattcttcttgagtgggggagttttgtataaaagaacaccagacattggattgttaagatgcatagatgctagacaagctatggttgtcatgtccgaagtacattcaggaatttgcggaccacatatgagcggatatgtgctggaaaagaaaattctccgagcaggttattattggttcaccatagagcgagattgtatcagttttgtgcgcaaatttcatcagtgccagatacatggagattcgattcattctgcacatcgaatttgcacacgatgtcggcaccatggcccttcattgcttggggcatggatatcattggaccaattgagccagcagcatccaatgggcatagattcattctgatagccattgattatttcaccaagtgggttgaggccaatactttcaaatcggtgaccaagaaagcagtggtcgattttgttcactcaaatatcatctatcgattcggaatcccaaagatgatcatcacggataatggtgctaatcttaacagtaatttgatggaagaggtatgccaacagtttaagattacacatcgcaattctaccccatatcgtcccaaggcgaatggagcagttgaggtagccaacaaaaacataaagaagatacttcggaaaatggtagaaggttccaggcaatggcatgaaaaattaccatttgcattgctgggttatcacactactgtccgtacttcagtaggtgaaacttcttatttatttgtatatggaactgaagtagtgatacatgcggaagttgaaatcccgtcccttcagattgtcgctgaggctgaaattgataataatgagtgggtcaaaacccatctagagcagttgaacttgattgataaaaaaagattggcagcagtgtgtcatggccagttatatcaaaagagaatggcaagagcatacaacaaaaaggtacgtccctggaagtttgaagtaggccagcaggtgttgaaacgtattcttccacaccaggctgaagcaaaaggcaagttcgcccaaattggcaagggccattcattgtgaccagagtgttgtccaatggtgctttatgtttaacagatatcgaaggaaaatgcatagacatggctatcaattctgatgtagtaaaaagatattatgtatgatttctttgttataactgttgattgtttgtatttggcattatttctaagattggaatgactaaagcaatttgttctgctatctaaacactttaccctttgttcccccttatgagccatatttatttctttgcatacctcccttttggaatcagtaatgaaaaagagagaaaaagaaagaaaataaaggagaaaataaaagaaatgaaaagtataacaacaaggaaattcaggtgtgaactatgtttgacctgattcctgttaaggatacgtaagcagctttacggctcagtcatagtaaaataaaatatcaaaagatccccaagcaagaaactgtggcagaagttgtatttgtaataaagaatgtgattccaaaagttgtaattttaaacccatgtcaaattgttttgagcctttgataccctttatttccaagcccatccgaaagcccacattacggtccaaggaaagaccttctaatcaatcttcgagatatgccaagtcgatcaaatagaggtgattcatatcgaggtaacactctggtccaagcaagaaaaataatgaaaaggagagagtcttattggtgaaaaccctcatgggcaccatgaggcaacgaaagctgagagaaagtaaaaatgagagagtcttatcggtgaaaaccttcacgggcaccatgaggtgacaaggaattgagaaatgaatgaatgagagaggtttgtcagtgaaaacccttcagggcactacaagtcgaacaagatccgtaaagttggcggaaagtaaatttagttgtgggaaatcttggagcacgaagtaaaataatttaaaaaagagattggataaatagaatgggctgattaatccaaaatgcataccatgatcattggtgtcggtgattccgctcagatgagtcccttttcttatctccaacaatcatccaaatttggattcttttctttattcttaaaagccttacatttcattgctgttaattttacttctctaaagctcttccaagttagccttgtaagaagaaatttcaaagcttactactagttttgaaattgcacaaagcaaaatgcacctagaacatgccagagatgatataatgaaaagtgggacatagggtgtaagcaaaggttatatcgatggaattgttcagtaatgtcgtaggagatatatgagttcagacaaaaaggtcagaaatggagaacaacagttagggaccctacagtcaaggatcgatcagaaggtcaaaacagtcttttcggccagttcaacacagttggacgaagcaaagaatggcaaaaagaaccacctccagcaagaatgccacaactaactaccacgttttaaactgacaaaattctctttgatttaaaataggggcaaagatggcatttcatttcaggaaatcatccatatggagagtaagtacgaggcaggtttgatcgcagaattctcaggaccctcctgaaaaatgggacttagtttaaaattcaaaataaccatgagtaccggaatttggcatgaatgcaccatagaggattataagtggagcttcgaagtttgtatgttgagatacactttggaaattaccccatgagaacaaagattctgatttctcttctttcccagattaatgattatgattttctacatcctcaactttttccccaagcagaaacaccatctttttccactttttccccaatttaatcggaaattctcaggaccctcctggaaaatgcgacctagtttaaaaatcgaaataatcgtgaaaagcaaggtctagcataggtgtaccccaaaggaatataagttgatttcaaagtttgcatgttttaatatgggattcaattaggaatttttaggaccctcctaaataatgggacctaacattgagattttttattagataacaagatttagcaagagtcacacctttagaagatataacttatatttaaaattgtcatttaattaagagtggtgaggacccacttggataacgggatttagctttcaaattcttattttgtaacattgttcaatttaacactcacatataagcttagctaccaaactagggcagaaaatttttctttgtttttgtctattttgttgaagtcgggagcccgcctggaaaacgaagggaagaaacaattcgagttcaagcaatcaggcatccacctggagaataaggaaaagcagcggaagattcagcaatcaggcgtccacctggagaacaaggaaaggcagtggaagattcagcaatcaggcgtccacctggagaacaagggaatacatttcgagttcagcaatcaggaacctgcctggagaacaagggaatacaattcaagttcagcagtcaggcacccaaatggagaacgaagggaacaagcaattcaggttcgagtaatcaggagcccacctatagaatataagataggcaacaatggtcaaagaaagatgtttaaaggttcagcaatcaggtacccgcctggaggagagggaaagcatatcaagaatgcaattcgagtcagcagcaaaggaacaactgagggaaatacaaatcaacaaggcaacaacagtcacaagaccaagtttgaaaataaatcattataaagcatagattgtagcttagtctatcttcttcatttttgtcatggtgtaataaggaggttagtaagcagtatcagcagcagcaatagtaacagtgaaaccacagctttatggtagtcccagctaccgaaacttcccgaactacattgacctgattcctttttagccaaggatatgtaggaaacctttgaagcagaggttcggtcaaatctttcaaaaaatgcttcctacggagtattcaaaacgggcaaatatcgctcgtatccgttcactttatctttgcgcaaaaactttttgtgttttcgggcaaagaggggcagctgtgagcacgtgatttttgccctataagaattactcccaaaaaattaaaaataagataattttttccgttgtttgcaattttgtggatttttatagtattttctgttattatttgcatgagttcatgcatgtttatatgtttaaataaataaaaaatacaaaaaatagattgaatttgcatttaggatttaattttataattttttttagttgagtagtaaattacttatttttacaaaaatgaaagaatcaaaaaataatgtattttgcatttttaaagtatttaatgtaaaattgtgtgattattttatttttagtatttaattatttgtgataaatattatttaatgtggattagtattttaagtcaattttggttttataatttgagttaggatttttggttttaaatttgaaaacaatttaggaagaaaaagaattaataaaagaaaaggaaattaaattggggcaaactcaatttaaccatcaatgcccaaatcaaatacaccccaaactagcccggacctgtctcccccaacccgttccatctccagcctcaaccaaaacgacgtcgtttggacatgctctaatctgggccattgaatcaacctgatcgaacggtcccaaacctttcccacaacccgacccattcccatacccaaaccacccacttagccaccaaacgaccccatttttccccttgatcaatctggatcgtcgatctcctctaatccaacggccccggttaattccccattttaatataccaaacaccccccactcgtctcttcagagaccaagaacatgcaccactgcacgctgccctcttccgcccaccggaaatcgcctcatggtggtttcggtggcccaaacaaccccaaattaacaccagtgattctccttcacctcattatctcaaatccttaaactgttcctttcgaatcacggccgaaatcgtcgaatcttcaatcgaaatttgaaccccgaaccctagtttacccaatcgaccccaaactgacaccccataaccttcctgacctccttatacccaatacatatctggtttccctctaatttgtctaaaatagatcgaatttcaaatcttgagttctgattctaaaagtcagagttaaacacaagaattgttgatgatttcaaggccgattttgtcgcaaaatggtgttaatcatttgttctaacaaagaacgcttgactaacatcatttggcgatgaagtcggaaaaaattcgagtgccaaatgaacctgttgagttggtgagtatccagtactacttcttttcttttcttgttattattccacttctgccccgtcttcttcttttcttaggtttgaattaggcttaaaattgtgaattgtccattcgattgtctttggtgcatatccatgtatgtcgttaattaatttaatagcgatgttgatttttcaaactagttaaaggttttagtcttttgtttactataattgtggtacttcgaaacttagggagggatgaataacagaagccttgagggtaatttgggtagggaaacctgtcaataattaattagagggcttctcaatagtggtagggtctaggaaatgcactactgaattaattataagcactaagtagtggaatgaattaaaaatgaaaaggggacttgtagtggctggcttaatgcccttttaggaggtggaaatcagagaacatgggtgatgtaattaaagactaaaaaatacaggtgtaaaagggtatacagtctggaaagggaggggaacagaagaaaaaaggacagaatacaccttaaaagggggatactcactgatatataagaagcaaggactgactttgtgtaaaaaaaagtagagagatgcagagatagagagagataagcattaagatatacacagcagttggatattctaaaataggagggagggagatccaaatactctaaaatactaagaggagaaatttctgaaaataccaggcagcagtagaaactattgtttcattaagttatcttggtgatttcttagatttcaaattcctgaaatgaatcctagttcactatttcattgatctctcttgttttgatttttttttcaaattttcaatctgtccaatctagtttagttcattcgagtgttagaagtggaatggatttcgttttgagtgggatgtgaagtttgctgaacaagtagatactctacgggtttctggggtcgatcttgacacctggtggttagaatatgaggtttatctgttgtactgttgattgtttgagcttgctgaatctcatttcttcattgtttaccctcttttccaggtatacacttctatttccacctaatgtaaagcttggcttggaatatataaaagatggatttatggagctttgagtaggagttatgttgtgttagtttacttgtttgtttctatttcattttggtagttttgatcgttacccctccacccctgaatatgtgatcaagagaataattttctaaatattgtagattacatgatagtttggatgggtatctcttttagttgaagccttttaaatatattcggttggttgcttgtttttgctttaaggtctggatttgagcctggttgaatatagctaactcaagatcttttggattgttaaatatgtactagttaaggttgttccaatgtttatttgtcgaagtaaataagtattttgcttcctgctctcttatgagtttctgaaatgtatggacttttatggtaatatgatttgtttcgatgctgtaattgaatcttaatttattgaatcctgctgtcagttaattttttaaaattcactactgctaatcagaacagaagggtatttgtgtggcattgtgaagtttagtcattgccggggactgatcatttagcagctgtaatcactagttgatcacagttgtaaattgacgaccatgtactcatgctaagttatttaaattgtccgatggtttgttttcctattcttgtttctctgtacgaatgtttgataggcttcttatgattagctgcgatctcatttgtattcaaagatctacatgagttctcgtataactagcaggtagtgtgttaaaattggaattctagtgaaaagtcaattgaagttgtatgtgtcaatagcacatgggtttttgtaatttcaagcattgaaagtgtattgcgtgattggcagtataatcgtttaagtcgactattcatgcacctaacaaatgttgaactgggtattagtttttgtacaagtcatttgtgtattctggctcatgtaatattgctatacaattgtttcatgatatcatcagtttctttctagtttgatttgaaaataaaaagggtataaggattttcttttggaattcaggatccatgttggtagaatccatttgacgtacatgtcaaaaattaatatttacacatctatccacattgaccttccataattaatggccctcacaaaactagttagctttttatagaaaacttgaactgcgccattttcattaaataatccatggcccttatgtaattaattttaatccttagaaaccgagcgtgccatttagttaaatttccatggccctcgcaaagttaaaaaatgcatagttgcattaggcgcgtaatttaaaattaccttcctaaactcgggtgtgcatttcatgtgacccaaattaaaatcccaacaatgttaaataaaatgtgtcgtggaccgcgtggttcaagacatattttaaatgacgttgcaatcttcctaaaaaatgaataagagcgattaataagttaaaatataatcataggctaaaacatgtattaaatcagataataggccaattataatagttgagcgaccgtgctagaaccacggaaccggggaatgcctaacaccttctaccgggttaacagaattccttaccaggatttctgtgttcgcggactgtaaaacagagtcaatcttttcctcgattcgagatttgaactggtgacttgggacaccataaattatcccaagtggtgactctgaatttttaataataaatgaatcccgtttcgattgtccctttaagttggaaaaaacacccttataccctttccggggtgtaggaaaaaagggaggtgtgacaccacctgagtgttgtagctgaggaaattgagactaaccctggcgacctgaatgaccaccccaaaaactctggagcggaggtgcactgataggagttggtggtgcgctgtaggactattgatcggaataccacatctgcggaccacggctacctgaagcgccgtgagagacttgaagagatgactaaaagggcctaggaggatggcctctaccatatgaatccctgcatccagaagaggcaccactgaatctacctgaatgatagggcctcttatccgaccattgaccacctccctacgacaggaccatctccactctataggccacattggccgcctcctaaaaagtgatctcactcctagcctccctagccatttgaaagagaatgggctgaataagaccataaataaacctcctcaccttctctctctctcggtagaaagtatgaaaagagcatggcaagctatgtcgatgaacctggtctcatactgggtaaccgtcatggaaccctgctggaggcgctcaaactgcctccgataagcctctcgctgagtaatggggagaaacttctccagaaatagttgtatgaactgctcccaagtcaaggctggcgatccggccggtctagctaagcaataatccatccaccaagtcttgggggatctaggcaagcgaaatattgcaaaatcgaccccattggtctcaataatatccatgttcttgagaactcatggtagctgtctagataatcctggggatcctcagtagatgtaccgttgaaagtggaagtgaagatcttggtgaacctatacagcctccacaaacatcggcagacatagccgctccatcacaggtctgagctaccacactcggctgaattgctccaactggctgaaccgctggagtctgaatctgaagagctacctacttcggagtgcgagtagtaggagtctagccccccctccatcccgagagacggctggtgctacaggaagcaagcctactggtgacgctctccatgagacccactaatcggacaagagcttcctaaaggactggggtagaaataaacccctctgggacctgagctaggcctactggagttgctggagcctcatcatcaaagtcaacttgaggctccactattggggctgttgctcgggactgagctctacccctacctcagcctcgccatctgcccctcgtgggagctactgctgggggctcgagctactgagcggtagatgaggaagcgtgtgttctcgccatctgcgaaagaacagagtagaaattcaattagcattgagaaacagaactgcactacatgaaagaacaaatgagaagttttcctaactctatagcctctggggataaatacggacgtctccgtaccgatccctaagactctactaagcttgtccgtgaattttaaaacctatgtaacctacagctctgataccaacttgtcaggacccgaaatttcccatcctcgggagtcgtgatggtgcctactcgtagaagctaggcaagctacgaacttagaaatcattagctcttctgttttaatctctttttacaacttatagtaacaagtgataaacatctaattgacatcggaaaatgagatttaagcggaagtcttaaataaatataaaaccaaaatgtttcgaaagtcaacacatgcctctacccagaaactagtgtcacaatatccacgaactacaaagagtactacatacaacagtttgaaggaagaataacattgtttgtatcggatgcatgagataacagaacataataaaagatagaggagatgtcgggcctgtgaatgcctacaaggctacaccagtgtctcggtggactgaaggctggctcccctactgctgctgatcaagtgtcgctccggtatctgcacagagtgcagaatgtagtatcagcataattgaccccaagtgctggtaagtgcctggcttaaccccaacgaggtagtgatgaggctaggaccaaactccagatgaacctgtgcaggtatataatatatggcggaaaacaaacaggaataagtagtttaaaaatgggagagggtacaagcttcggggatacatatcaagaccgacagaaacgtaaaaagatatgaaaggatagctcaatatgtacaacaatataataaaaatattgttgtggtgcgtaacccaatcccttatcatttagcattgttgcggcatgtaacctgatccacatatatttagctgtttcggcgtgcaacccgatccaatataatatttgttgcggcgtgcaacccaatccaatataatatctattgcggcgcacaacccgttccaattatacagttaacaataatcataattaaccgtcccgacaaaggatcaacaatagactatattatccccgcaagggaactcagcagtacaagtatatacgtcccagaaaggaagaatcggctagaaccaatcttaactcaactcctactcgtctcaattaccaccatttctcaatcataagaagatcctacgataaacaaactaagtctttagtcaatatcaaggatttactcactatttcaaccatagtaatattgaagaatataacaagtatcaatttaagactcacggtcatgcttgacaccaacgtataaatatttgtcaccatgcatataaatcatactcaacaagaagcaaagagcaaatacgactcaactcctaatccctcaagctaaggttagaccagaaacttacctctatacaacgaacacaattcaagcctcaactacagctttacctcttgttccaccaccaattcgcttgtatttggtcacaagttacttaattacataaataaacgctaaatgaatcaatttgaatacatggaaatggattttccaaagttttacccaaaagccaaaattgcccccggccccacatggtcaaaacctgactttcgaaccaaaaccctattacccattccccacgagctcaaatatgtaatttgtttttaaatcggacctcaaatcgaggtccaaatccctaatttttgaaaaacctaggttctacccaaaaacacccaatttcccccatgaaaataattgatttgaagttgaaatcatgttaaaagatgttaatgattaaagaaaactagttaaaaacgacttacaattgatttggagaagaaaggttgtttgaaaaatctcctcttatgtttttgggattattgaaaagtgcaaaataactgaaaatatcgtctatttatacccctctcagaccccctgtgtgtaccgcacaaaatggactgcggccgcacaggtcttcctgaggtactgcagtccagtgccatgtgtggatcgcacgaaatggactgcgtccacacaagcctccaccatggaccgcaagaaatcgagcgtggccgcgatggcttggccttgctcaccgcggaccgcacacatcccaccgcgttcgcggagtccccatcgcggaccgcgagacctggcttcagagacctgcaacttctctgaatctgcaacttttccctatgtgtaaaaacatcccgaaactcacccgagccctcggggctccaaatcaaatgtcatactaattaaaaaatatcatatggacctactcgtgcgatcacatcatcaaaatcacatgtaaaatcatgaattaaatctcaaaactcaatattttcatcaagaactctcaaagttcataactcttcaaccggaagtccaactcacgtcaaataaactccgttttttcaccaaatttcatggcaacgtcttaaatcatatataagacctataccgggcatcgtaaccaaaaaacgggccctataccatcatgttctaagcaaattttattttaattttccttaaaaagtttaaaaaaaacaatttcttttaaaaatttatttctcgatcttgggacctcggaattcgatttcgggcatacgcccaagtcccatattttcctacagaccctcggagaccgtcaaataacgggtccggatccgtttacctacaacattgaccgaagtcaaattaactcatcttatagccaaattttatcatttttcacagaatttcatatttaagctttccagctacgcgttcggactgcgcacgcaaattgaggtgactctaaatgaggttttcaaggcctcaaaacacggaaactttgttttaaaataagttatatccttttgggtcattacgcaaatggtctcacacttagacgcattttcaaccatttttcacatcttctcaaaatataaactctctagggagattttttcaaaggcaacttctcttcctaatcaattgtaagtgatttctaactagttcttcaatctttaaaatcttttcacatgatttcaactcaaaatcaatgattttcatgggggaaattgggtgttttcggtagaacctaggtttttaaaaaattggggatttggacctcgatttgaggtccaatttcaaaacaaattatatatttggattcgtggaggaatgggtaatttggttttggttcgaaccttgggttttgaccatgtggtcccgggggcgatttttgactttttgggtaaatctttggaaaacttattttcatgcattgtcattgattcatttagcatttattaatgtagttaagtaacttgtggatacatacgagcaagttggtgctggaatcaagagttaaaacgatagttgaggcttgaattgtgttcgtggcatcggtgtaagtgtttggtctaaccttacctcgagggattaggagtcttgtcttatttgctatgtgttaattgtggagtacgacatataggcatggtgacgagtatctatatgtcagtgtcaaacatgccccttagtcttgtattgtaattgttatgactccgttgtggtttattgcgcttcacatgttattatcattattgttcccttgccgggatgttattatcatattattgttcccttgtcgggatttgttttgatattattgttcccttgtcgggatgttgttgaaatattattgttcccttgacgggatgttgatatattgctcttgttaccttgccgggattcttttgtgattgttgttgatttgtaactgggatcaggtggcatgccaccacggaaatatatgaaatggacgcgagttgcacgcatgcaacaagatatatgaaataggagtgggttgcacgcctgcaacgagatatatgaaatgggagcgggttgcacacctacagcgagatatatgaaatgggagcgggttgcacgcctgcaacgagatatatgaaatgggagcaggttgcacacctgaaacgagatatatgaaatgggagtgggttgcacgactgcaaagagatatatgaaatgggagagggttgcacgcctgcaacgagatatatgaaatgggatcgggttgcacgcatgtaacgagatgcatgaaatgggatcggattgcacgcctgcaacaagatgtgaaatgaaagtgaattctgtatttgttttccttatccttgttagtaattggattttggtttctttatattcctcttgatattctgttgttatctgttattccccgaaggatgtttccccccgtaattatctgcttttattttttcgttgtatatggtttaactgcacaggtttttttggtagtatggtcctagcctcgccataacttcgccgaggttagactaggcacttaccagcatatggggtcggttgtgctgatactacactctacactgtgtatgtagtattctcctgcagacgtccgcgggccttggcgtcacctcctatctttactttatcctgtttcctttacttatttcagaaacagtgtatcttttatctttcagactttgtatgtagtattcttggactgtctgtgaaactgtgacaccagttctgggtagtcgatgcttaaacaattgttagatacatattcagataatttattgctttcttgcgtttattataaatttcgttgtctacaagttattgttttataattgttgaagaatataaaaggggtaaaagggtaattagttcaaacaatcggcttgcctagctcacattagtaggcgacatcacgtctcccgagggcggtaaatccgggtcgtgacattttttgaaatattttgtttacatttaaaaaaatattccacgtcataccaattttttctatatatactctttgttacacttaaaagtcgctatagaaactattaattagaaaccaatttctctcttgttgagttttaaaaaaaatcattcacataatctaataattcaaaactaatattcttcaacgaaaaaaatattatactcttgcaatattggcttgactacagctaaatgaaggggtttcagcttatacctttcaattcattgaatgtgctaaataaattaatgatagcaactatatagccaaagttttgttatttgtttgatgtccattcatgtaaattgactcttcaaacaaatattctccaagaagaaaaatgaaacaactttttttttaatattgattgattttgtgatgtttctttctccagcatgtaagtttactttattatatatgcaagtaaacttttatttggtcgtgtaaactcttttttgttatttagataaacatagacatgtaccctatatattacatttattttaaaagatttcattttattcaaatctagctacagtgtttcaaagaactatacttataggattttaaatgtgaaaaagttttatagttatatggagtaatttttttttttgctagaggcgaagtagtattttaaataattagaaaaaataacaaagttcctaacatgattgcatatgatcattaaccgtattaagtatgataacatgataaaaaagataaattttatttttgatttaaatgcgaattttaaaaatttatctataaattaaaaattatcttttaattcaaattccttatatatatatatatatatatatatatatatatatatatatatatataaaaaactaaaatagtcaaatatagaataaagataccatatactattgatatttattagcttgccacatggcttaaccatactgtcaattatatatggtaactttcttgctttaatatatatatatatataatctatatttttaatttgggatttaccagccacctatcattaattagaccgttcaaaaagccgtatatttcgaccagctagcatccaagtctaacgtttaccctcttcaaaatatatatatatatatatatatatatatatatatatatatatatatatatatatatatatatatatatatatatatatataatctatatttttaatttgggatttaccagccacctatcattaattagaccgttcaaaaagccgtatatttcgaccagctagcatccaagtctaacgtttaccctcttcaaattttgtatattatctttatttgaattatacttccagaatcgttttccctccatgtgtttaaagttctctagaataaaattacaagaaaataattgtcaatttactccatccactagctagggatgtacaaataaaatcgagaaaccatactaaaccaataatcagaatcaaatcgagaaaaaaaccccgactatgcatggtttggtgttgggaaaaaaactcgaccataattgatttggttttaattaaaaaaagacaaaccgaaaccaaaccaacccgacattacatgtatagaaatttaatatatttaatacataaaaatatttattgtagtgtattttataaatatttatttgtgatgacccacaaggtcatcacttgttttaaaagcaattttatgttccgaggctttgaaaacctctttctgtctcacctcgcattatgtgcgtagtccggacgcgcttttggaaagcttctatatgaaatctaagtaaaaatatggaaattggcttttaaaatttgataaaagttgactttggtcaacattcttggtaaacggacccagacctgtgatctgacgatctcgtaggatccgtagtaaaatatggagcccggtacaggtcctctataataattaagttgaatctgtaaagtttggtaggaatcggagtccgtttagtataaatcggacctttatttgagaaatggaaaattttgatgttcttgagagatttcatgaatttgaggcttaattcatagttgttgatgttattttgataatttgatcgcacgagcgggtccgtatgatgtttttggacgtgcgtgcatgtttggtttggatccccgagggctcgggtgagttttggataagccacgaagtgaatttggacttagaacataacagttgcaggttcagagaaagttgcaggtctctgaaaccaggctccgctgtcacgacccaaaatccactaaaggtcgtgatggcgccgaacactgctgttaggaaagctaaccaaaatacttaattaaattctcgttttaataattttgaaaagtatgattttccatcaaattttactagtaaaagataaactttacaatgtaaataaaagaatgtttagaaataaatataagatacccaataatcatcccagaacccggtgtcacaagtgcaagagcatttactaggaatgaaataaaatataataactatctggaataaaaagtggacagaaatgaaaatacagtacaacactctgaaagggactctactggctgcgggtcgtctcgacaaatgcagctcacctaagtctccgtatcaaccatgccgatatgccactaagccactagccacacatgaacatgtgcaacaaaaatgcacatcaaatgtagtatgagtacgaaaacaacgtgtacccaatgagtatcctatctaatcttgaagaagtagagacgagaggtcgactttgacacttactagtggtccaatgataatatagtgaaatgtgaggagatcatgggttttttataaaacaaacaattataattcataaaggtaaacaacttcccaaataacaatggatttccaaagaattacttttcatcttctttatcaatttatctctggccagggaaggaaaatataaacatttataagtctcaggcaaaaacacaagcatgcgcatatttgtcacgaccctaaaaccaacccggtcgtgatggcgcctatcatgaaactaggccagccgacacaactcccgaaaatttaaccatttaatcaataacagtaatttttaagcctttaattaaggtaagtctaaataaatagtgctgaataaatatacaagcctgacatcggagtgtcacaagtcacgagcatctactaaggtctgaatacaatgaagagtctcaaaatatcctaaatacaatataaggaagacaagagggagaaaagcagtgttgcgtacgtcggacaactatcttgctaactccgatgactttgtcattgagcaatcaacacccgttaccgggttcagaagttcctgaatatgcacacaaggtacagggagtaatgtgagtacgccaactcagtatgtaataaaagtaaatgaaaattgagcagtaagaaaatacgtaaaacacagcataacgctacagcaaacgcagtacatttccaaaatagtacagaatcattttcttagtaaatcaagcccagtttcaataaaacccttttaaacaacttccaatagcttcaagtaaatgataaaaatagtgagaaaaaaatagaaacataaacagcccctcgggcaaaatatgtaccataaaccacccttcgggcataatatcaatagaaccagcccctcgggctacctcacaatcactcgtaatcaactcctcgggcataacatgaatcaagaactgcccctcgggcaaaacatggatcaagaatagcccatcgggaaacaatatgaaacaacaacagctcctcgggctacattatataactcacactggataccctcgctcactaagggtgtacagactccgggagcggccccttacggcccaagcacaataacaagccatctaatggcctaatcaaacaggatctcggcctcatatcaagccacatcatagcgtaacaaatcaggccctctgcctcataatcatgaatcagtacaacactgctgcagcgcgcagtccgatccctcagtatcctcataacataggccctcggcctcacacagtcagaaatctctcaagacactcgggcaacagtaacacgtgatgctcagcccaaaatatcatttaaaatataaaaaatggagtaaatatgtctaagttatgaaataggtagaatacagcataattgagtacaaatatgaagtcaaaatagtgaggaatagtagtaaaaattccctaagggtccaaaacagttggcacgaggcccaaatatggcattcagcccaaaatatggtaatactttccaaaacacactgatatcaaatagttttcattcaaatacgcgacttagcactcgtacaggacggaccaagtcacaattcccaacggtgcacgaccccatgctcgtcatctagcgtgtgcgtcacctcaaagtagcacgacgatgtgaaatacggggtttcatatgcttaggacaaacatttacaatcattacttacctctatccggtccaaactctagcctgcgattcctttgccgctcgaatcggcctccaaatgctccaaatctaaccaaaatcagtatattatcatcaacatacactaaaggaagaaagaccaagcgaatattattaaattacatcaaaaatcccgaaattggcaaaacccaaccccgggcccacgtctcggaatccgataaaaatcacaaaatctgacaaccgattcaaccacgagtccaaccataccaaaattactaaatttcgataacaattcggccttcaaatcttcaaatcttattttcaaatatctaggttcaaatccctaatttacacctcaaaaacatgtaatctagtcggattattcgatgataattcaatattatggagtagaaatgatcacaagtgacttacctcaagatttctcatgacttctcgctcaaacatcgccccaagccgcattcttttcgtccaaaaatgtgggaatgagctaaaaaaacaagacaactcaataaaacacgattttggtcgccaaaagcccctttcccgtcgctacaagtgccacatctagtcgctaaaggtgccaccagatcctgctgcatcagtaatatttattttcactaaaaaggctctaactctaccatacgaactcggaattcgatgattcttattcctatgagtcacaaataataatacgaacatagtccttcaatcgaaactcaattcgaagctcatttgcgcagtacgatatccatttagctcgttaaacaattaactcatgtttcccttcgaaaacccaatcgcgacttgatgaaattagaccaaacttttcagatcactcctataattcattatcaaaattctggaattcttgaaatcaaatttcattctctagaactaaaaatggacctttggatcattacatgcttatgctcaaaacagcaaaatcctccaaaaactcttccaaaacttatccgagactcatgggaccccgaaaaatatgccaacacaccccataacatcattcaaacttgttccaactttcggaatgcaaaaaacaacatcaaaacatcgaatcaccctcagattcaagcctaagaattccaaaacttccgaattccgaattcgatcaaaaagtctatcaaacctcgtttgaatgacctgaaatgttgcaaacacgtcacaaatgagacaacagacctactccaatttccggaattccattccgaccccgatatcaaaatttcgactccccgaccgaaaaacgccaaatttccaatttcaccaattcgagcctaaatctaccacggacctccaaaatacatgccggatgcgctcccaagtccaaaatcacctaacggagctaaccaaatcataaaaatccaaattcgagattgaatactaaaaagtcaaaacttggtcaaacctttcaaatttaaagcttcaagttgagaattgtttttccaaatctattccgattatcctaaaaaccaaaaccaacgatttacataggccataatatatcatatggggctagtcatgccggagaactggcgagcaaagtgcaaatgctcaaaacggccgatcgggtcgtcacaagagcattgccgcaaaacacctgtagaaactcattacctcgtaaacacccaaaaaactaatcatatccttaccatgctgatccggcctactaccaagctatcccatctatccaaattccttctaatttaccttcaacttgatacttcttcttgccataacaccacaatcctcgacccagactcgccacacgagacccaagcataaagccacattgtcctatggttcataagccgctgactactctctcaaatatcccctaaagcgccacattcgaaatattttccctgaagagacatcatgcaaatctaaaggcattaccttcacctcctgatattgatgtatagaatccataatgatataaaaataccacgagtcttgacaccctccaatgcaaaccccagtttctaacctaatatacaacttgaaaatctccaattattaaatgtaacatcttgaacccattagaaccattctcaaaagtcatccactctactcaaaccgcaattagaccgatcaaacggaccgacgatctgtgctcattagcactctgacaccgcataatgtaacttcaccttaatgcaactaagaaacttcatgttctatgcaacatacatcctttaccaataacaactcaagtcattccgtgattctcatacacccataaagcataacaaaacctgtattgaaatttcctttactagagcccttctcgggatcaacctccataagccataactaattcaccagtacgcctcaaactagaaccaacatagcacataactgtgcaatcaactaattaattgcagactcccccacttgactcaaagccatagatgaaaacatacaataactcataatgcatatactctatcagtaccataataccataatgagattaaactccatacttcataagctcctacaacacagaccatctcgtacttcaaatcttctgcaaatctcacatttaccctcgcaacagtcaagcccactctcttaagtgacccaaattcaaattgcatacatatgtttcactggtaaaagagatcttccaacaaacaacataaggctcatacaaacttcagaacactctaaaggaggtaacccacctactttgcctcaaactaatagctcttcatacccttccaccgtcataaacattacgcaatcacttaatcttcctaagtctgaactcatatcataacatgaaatctactccactccccaactaaacaacatgaaaagattcttcacacacccataacttggggctatacatcaagttaagatgaaaatcaagcaccaattagttcttttatcctcaagcagacccttctcgttgcttccaaatcatatgaatacatctcgcagtcacatctcactcataacatagtcatccaaccatcacttccactaatagggacactaccggacatataaatttaaaagcacgtgctcacataatcagcacctcagtactcaagctacaggcaaaacccggcctcaagacctccaaattggcccaacatcaatacacagaaatcacatctcgcccctcgatcaggaaatcacaaaccatcaatgcacagctgataccgagcgctcatgcgcgcatcctcacgcatggaaggaattcaaagagttacatttcaagctgaatcaaggatgcacgataagaatataagaatgtgaagtttttcctaaaggttctgcagcctcccgaggataagtacagacgtctctgtaccgatccgcgagactctactaaacctgctcatgactcgtgagacctatgtaacctaagctctgataccaacttgtcacgaccctaaaattgacctggtcatgatagcgcctatcatgaaactaggccagccgacaatactcccgagatttaaccatttaatcaatagcagtcatttttaagcctttaattaatcaaatatctcataagataactttaaatgaatagtgcaaaataaatacacaagactgacattggggtgtcacaagtcacgagcatctactaaggtctgaatacacctaagagtctaaaaatatcctaaatacaatataaggaacacaagagggagaaaagcagtgctgcgaacgtcgggcaactatcttgctaactccaataactctgccactgagcaatcaacacccgctatcgagttcagaagttcctgaatctgcacacaaggtgcagggagtaatgtgagtacaccaactcagtaagtaataaaagtaaatgaaagctaagcaataagaaaatacgtaaaagacagcataacgctacagcaaatgcagtacatttccaaaacaatacaaaaatcattttcttcgtaaatcaagctcagtttcagtaaaacctttttaaacaacttccaatagtttcaaacgagtgataaaaatagtgagtaaaaatgatagaaacataaatagcccctcgggcaaaatatgtaccataaactactctttgggcataatatcaatagaaccagcccctcaggctacctcacaatcactcgtaatcagctcctcgggcataacatgaatcaagaaccgcccctcgggcaaaacatggatcaagaacagcccctcgggcaacaatatgaaacaccaacagcccttcgggctacattatatcactcacactaggtacccgcgctcatgggggtgtacagactccgggaggggccccttacggcccaagcgcaataacaagtcatcttgtggcataatcaaacaggctctcgacctcatatcaagacacctcgtggcgtaactaattaggcctttggcctcataatcatgaatcagtaaaacactgctacgacgcgcagcccgatcccacaatatcctcataacacaggccattggcctcactcagtcataaatctctcaagccactcgggcaacaataaaacatgatgctcagcccaaaatatcatttaaaatatcaaaaacggagtaaatatggttgcgttatgaaaatagtagaatacaacatgattgaatacaaatattaagtcaaaaaagtgaggaataatagtaaaaattccctaagggtccaaaatagttggcacgagacccaaatatggtattcagcccaaaatatggtaatattttccaaaacacaatgatttcaaatagttttcaatcaaatacgcgacttaacagtcgtacgggacgggtcaagtcacaatccccaacggtgcacgaccctacgctcatcatctagcgtgtgcgtcacctcaaagtagcacggcgatgtgaaatccgaggtttcatacccttaggaccaacatttacaatcattactttcctctataagtccaaactctagcccgcgatgtctttgcccctcgaataggcctccaaatgctccaaatctaaccaaaatcagtatattatcatcaacatacactaaaggaacaaagcccaagcgaaaattatcaaattacatcaaaaatcctgaaattggccaaacccgtcccccgagcccacgtcttgaaatccgataaaaatcacaaaatccgacaacccattcaaccacgagcccaaccataccaaaattactaaatttcaataacaattcggccttcaaatcttaaaatcttattttcaaatccctaggtccaaatccccaatttacaccttaaaaacatgtaatctagtcggattattcgatgataattcaatattattgagtagaaatgatcacaagtgacttatctcaagattccccatgacttcttgctcaaaaattgccccaagccacgttcttttcgtccaaaaatgtgggaatgagctaaaaaaataaggcatctcagtaaaacatgattctggtcgctaaaatccccattcctgtcgctaaaagtgccaaatctggtcgctaaaggagcgcaccagatcctgttgcaccaacaatttttatttccactaaaaaggctctaactccaccatatgaaatcggaattcgatgattcttgttcctatgagtaaaaaataataatgcgaacatagcccttcaatcgaaactcaattcggagatcatttccttagtatgatacccattttgctcgttaaacaattaactcatattttgcatcaaaacccaatcgcgacttgatgaaattagaccaaacttttctgatcactcctataattcattatcaaaatttcggaagtctcaaaataaaattttaatctccagaactgaaaatggacctttggatcattacatgtttatgctcaaaacggcaaaatcttccaaaaactcttccaaaacttatccgagccttatgggaccccgaccaaacatgccaacacaccccacaacatcattcaaacattttccaaccttcggaattccgaaaacataatcaaagcatcgaataaccctcggattcaagcctaacaattccaaaacttctgaattccgaattcgatcaagaagtctatcaaacctcgcccaaatgacctgaaattttgcacacatgtcacaaatgatacaactgacctactccaatttccgtaattccattccgaccctgatatcaaaatttccactgccgaccgaaaaaggccaattttccaattttgccaattcgagcctaaatcttccacaaacctccaaaatacattccggacgcgctcccaagtccaaaatcacctaatggagctaactaattatagaaatccaaattcaagttcgaatactaaaaagtcaaaacttggtcaaccttttaaatttaaagcttcaagctgagaattgttcttccaaatttattccgattatcctgaaaaccaaaaccgacgatttacataggtcataataaatcatacggggctagtcatgcccgagaactggcgaacaaagtgcaaatgctcaaaatgactggtttagtcatcacaatatcatgccgaggtcgtacggctcgatccaacataaatgtaaaatgtgcactgccgagggtcgaacgacacgaaccatagatgcatctattaccccgctcgcgaatcatacatgtgacacggtcacacatagatacacccattcaaacaactaattaagaatttatcggggaacgtttattcaaataaaagccaattctcttttactgattaagaaaatgaagttttaaaccttttagaaattcatttaccaattcaataggatttaagcaattcaactatcaataaaattacaaatattctaagtagagcatgcttttgggtcctagactacccagacttacacataatagtagctacgctcggactctcgtcacctcgtgagtgcatagcccccacaaatagaagcacataaccaattattttaccgatgaggacaattccctcttacaaggttagaaaagaactcacctcgctccgaagatccataaccggcattccttgcccttccgaagactcgaatcaatgcacaatgctccaaaactagccaataattattcaaatccattaatgtatgttaaattactcattacaatccaatttataacaattcctaaccccgatcgaaaagttgacaaaatcgccctcgggcccacatgcccggattccaaaaaatttcgaagataaagtttatccatgaactcacgaactcaaatatatgattttctctaaatttcataacaaaaatcgtggtcaaaatccaagaatatcaattctctagatttccctcaaaccccaagtttcgaccaattatttaactcaagataagtggggataacttaccctgtcgttgatcatgaaaaccccctctagaaaccttccaaaatagtccacaccaaatgaaaatggggaaaaaatgaccaaccccgacattaaaagaatacactgcctctaacctttccgcacatgcggggcataagccgcacctgcgaccatcgcttctgcggcacacgtaccgcttctgcggtcccagggccaggtccaaaagttgcttctgcggtctccttaacgcaggtacgctcccgcatctgcgtttagagtgtctcacctatggtcattgcaccccttcacccaaaccgcatatgcgacccccttggccacttctgcggctccgcacctgcggccaagacctcgcaggtgcggttacaccagatatcagctgcctcaattcttcctcaaattccaatattgatccgttagccatccggaatccaaccgaggcccccggggaccccaaccaatcatgcggactagtcccaaaacacattacggacttgctcgagatctcaaatcatatcaaacaaatcttaaaccatgaattgccctccaatccaagctcaatgaactttagaatttcaatcttcaacattcgatgccgaaacccatgaaatcacttccgattaacttcaaattttgcacacaagtcacatttgacatcacggacctactccagcttccagaatcggattccgacctcgatatcaaaaagtccacttccggtcaaacttctcaaaaaccttcaaatttctatcttaaggcaaatgacccacggacctccgaattcacttccgatcacgctcctaacaccagaatcatcatacgaagctaatcccagacacggaatccctaacggacatcgataacactgaaatgcacttcaacccaaacttatgaaattcttccaaaaatgctaacttctacaataggtgccgaaacgttcccgggtcttccaaaacccgatccggatatatgcccaagttcaaaatcatcacacgaacctataggaacctttgaatcctaattccgagatcgtttactcataaatccaatattagtcaattctttcatcttaaagcttccaaaatgagaattctctttccaattcaaccccgaacttcctgaaattcaattctgaccatgcatacaagtcatactacttgaagtgaagctgttcatggcctcaaactgctgaacgacgtgttaaagctcaaaatgactgttcgggtcattacattctctcccacttaaacatatgttcgtcctcgaacgtgctgagaactgcactggagttgtccgaaatcactttttaacacctcgaacacctacccgtgctaccacaactcaactgggaaccctagcttgatcaatctgaagataccctttttcacttaagcaaataagtcttagagcccaattccaacatccagaattctctgccatgcctgtttccaacatacactcaccgtatcaatcactgcatgcagcactaaaacatggctgcatacctctgctgaaatcacaccttgcactactttacttataggaccacaataacattctctaatcaaattagtcgaaattccacgaatacgacactcccaatgcatctcataacctatatacatattgctctgattcttaaaataccaccatgacggaagatgcacgtagaaattcataaacaactgccgaatcaacaaatcattagggctatactcacgacaagaatcattacctccttctgaaccaaataatggaatttactcttaaatattcttcatataatccgattgcactgaccttggttccgataatctcatctcacctagtacgaactgctcaggcaataagccacctagacatgaccaaaagtctcatatgatgctgcaatgtgccaataggctaccaacttgaacgtgatacacaaggaagacgaactctggaaaggactactcaactcacacaattgccattaactttcctcaaaaaatgaaaaacaaacacacaaaaacagaatatagaaactttactcaacatcatactgctgcggcgtgcaacccgatccaaacaacatacctatggcggtgtaacacccgatccacacataaaattccataaggagatacacacccagctaaattgctcattacaacaaaaataccaaatatctgtcacaagcacgctaagtgcttaataccatccctggggatacatatagcaccataagctaacaaacataagcacaactgaggtgcgatatatgattaaaatctcaagagtcatcctgctcacataacaccatcactatgtagaacctcaacacacaagaaatttatcaagctgttcacaactcacacggcacaatattgcattacaggaaatagccgacggcgaaataacatccaacatctgaatactattaaataaggagagttatgctgaaatgacacatctcacctgatatagagcccacattcatatttaaatccacccacagatctcaggtcgattctgatcgtaccaaattaggccaataatctttcctgggtccataacaaccccctcttttcccttaacagacaagaacaaccatcataaccggggctatcctccatagtccacaacccaataagtcgagtgccatccaggcataaattctcaaattaatgatgtcaccactatcttcatacttggtttaaattcttcaatcaatcaagtgactacctgccacacttatacaatcttcccgtggggcacgctcccacgaccttccgtaacagacaacaagtctgagcatctataccaccagtcgcactaacgctgagaaagcattcaagaatccataaccaggatgcaaagccctttaaacaccgatctcaggtgatgctgaagacaatgccagcttactttaaacattcaaatccctttcctgctcatccgagctcgtgacatccttgtcaacaccgaaccacaaccttaatcctcacttccaaatcccataacactcactgtacccaacatgccaatatacaatagaacacgattttcatcataactccggagccactaatagcttaacacttcatcatataaaaacttttcacttaacaaacttcaggagaaacatagcaacacataaatgaatcctcataatcatagaatatgcaaatcgtcaagtagtggtctaagaaaccatagaacttccgggatccgcctacacataacaggtcataacactggaatactcccaaataaaatcaattacggcagccgacaagcctcacacgtaccgccacaaatcacttgcataactcaatcacgctaaaggaactgatccctgccgccagtatgccgattcaaccatggtcaaccaatccaacttctcctaattcatcactaacttggcttatagataataatagctccattccttacatcaccaaccaaaatccgcacccatcttgagcgactccattctacgagaccaaattgtctccaaacccatgaaccgtttcataccctcattgcagacacattcacatctacaactgatacacccattctgataacttctccacgaatccgaagtcttttgctcatttttctcccaatgctacactgcaagtcaaacatatcatagaacattccgagcctctcgccatcatcttctacataagcttggttcttagtcgtacttataggctcgaaatcattaggcaccataccataacttttgaatcactaggaccgttgtggagagccacccactctgacttggtcccggatataatcaactccatgaatcttctagcatatgaccaccttctcgatgaagcactcggccaaaccactttcctttaaacccgcatctatacaaggcataaatcctaaatcctcccccaagtctaaagatgattcaatacggccaaccatagcacacctttaataattcctttgctcaaattacctcttatgctctctcccttagctgaaatgacttatcaatatgctaataaccggaaatctcattaataggcaaccatacattccaaccgtaggcggtgggactctcccacttagcttgaagccacaattacacaactcttgaatccaccaatattctttatctcttattgacatgaccttgcgcaattaaaccgccagattccttgaaatccttccattagcacttcataaatactctgaatttccatcaaaattcacatattcgacctcttaccggatggccattaaaatccttcgcagaagcttcgccaatcacgcgatcgctaacctactcacagggaataacccacctactaaaattacctaccgacttcttccaatgtcgttgcatggggtacaattactacgacatcaatagtccatcctgagcccgcgctcatccaccagctacacaagttcattcacttctcgtggacattaactaaacgtatgacaatatcttccaattcaaaattatgttgtatccttcttcatatcaagcagcttctttccgtcatatcaaatctcccgccgttatgctagtcagtaattcaaattaggcttgtaaacccaattaccgtccactaaaattcccccaaatcattccaaactttccttaaggtgcgtaatcatcctaccaccagacccatatgcaactccgccactctcccactttggcgaaacctactcctttaatcaactactcgaccttcgctactgatacctggctgccttaaaaattcaaccatcgcatgacacctcccacatgtacttcctcatccttcgctgcccaattattgccttaaataaaatctatcttcttagcacttgcacccacaaatcgctactaactttaaacctttccgaagatcatctttctcgccccgtcaacattggaagcactgattcaatcctgaaccaccgcaccccgcgatctctgacagccgcttctcaaatactatttcacaatatcctaccccaaaagcgaattgctaaaggccataacatcggcgaacttaacacattcaatcgaggacgatgacaccacattgtagatgaaaattccaccacgctcgaaaataccaagtctcgttacttcctctacccaactctggacgttcatgggccaattgttttttgtccgccgaaaataaaatattgaatctctgaatcatacactgagtagacttccattcaggtcattcaccaccccaacacataggcaagaaccttaccaacacgtccctactatgcaacaactgatcatgagcaatcatagaaatctgcgcatagactcaaagctctcaggatactgttactgagctgaaatgacaggatatccctccgcaaggcaacgacaatagcccaatcaactatgcagggagaaacatcccgcaccacatcaatagtaacattaaaattcttcaattctcgatttataataagcgcttcgcgtcgcataagattaagtaggaaggaaacaagggcataagcctcaaggaatcaaattggacgatgaggaatcaagaagggaggtgttcctaccagtcctgtagcctctctaggataagtacatgcatctccgtaccaatacgcgagactatactagacttgctcatgactcgtgagacctaagggaacctagtgctctgataccatgttgttatgacccaaaatccactaagagtcgtgatggcgccggacaatgctgtcaggtaagccaatcaaaatacttaattaaattcttgttttaataattttgaaaattatgattttccttgaaatttcactagtaaaagataaactttacaatgtaaataaaagaatgtttagaaataaatataagatacccaataatcatcccagaacccggtgtcacaagtgcatgagcatttactaggaatgaaataaaatacagtaattatccgaaatacaatgttgacaaaaatgaaaatatagtacaacgctctaaagtggactctactggctgtgggttgtctcgacaaacgcaactcacctaagtctccgtatcaatcataccgctataccactaagccactagccacacatgaacctgtgcaacaaaaatgcacaacaagtatagtatgagtacgaaaacaacgtgtacccaatgagtatcccgtctaatctcgaagaagtagagactagaggtcgacttcgacacttactagtggtccaatgataatatagtgaaatgtgaggagatcatggattttttataaaacaaacaattataattcataaagccagatagcaggtaaacaacttctcaaataacaatggatttccaaagaattacttttcagcttctttatcaatttatctccggccagggaaggtaaatataaacatttataaatatcaggaaaaacacaagcatgcgcatatctgtcatgaccctaaaaccgacccggtcttgatggcgcctatcgtgaaactaggccaaccgacaaaactcccgaaatttaaccatttaatcaataacagtaatttttaagcctttaattaaggtaagtctaaatgaatagtgcgaaataaatatacaagcctgacattggggtgtcacaagtcacgagcatctactaaggtctgaatacaatgaagagtctaaaaatatcctaaataaatataaggaagacaagagggagaaaagtagtgttgcgtacgtcgggcaactatcttgctaactccgatgactttgccagtgagcaatcaacacccgttaccgggttcagaagttcctgaatatgcacacaaggtacaaggagtaatgtgagtacgccaactcagtaagtaataaaagtaaatgaaagttgagcaataagaaaatacgaaaaacatagcataacgctacagcaaacgcagtacatttccaaaacagtacagaatcattttcttagttaatcaatcccagtttcaataaaacccttttaaacaacgtccaatagcttcaagcaaatgataaaaacagtgagaaaaaaatagaaacataaacagcccctcgggcaaaatatgtgccacaaaccaccctccgggaataatatcaatagaaccagcccctcgggctacctcacaatcactcgtaatcagctcctcgggcataacatgaatcaagaaccgcccctcgggcaaaacatggatcaagaatagcccctcgagcaacaatatgaaacaacaacaactccttgggctacattatatcactcacactgggtaccctcgctcactgggggtgtacagactccaggaggggccccttacggcccaagcgcaataacaagtcatctcgtggcataatcaaacaggctctcggcctcatatcaagccacctcgtggcgtaacaaatcagtccctcggcctcataatcatgaattagtacaacactgctgcagcgtgcagcccgatcccacagtatcctcacagcacaggccctcggcctcactcagtcagaaatctctcaagacactcgggcaatagtaaaacatgatgctaagcccaaaatatcatttaaaatataaaaaatggagtaaatatgtctgagttatgaaaacagtagaatacaacatgactgagtacaaatatgaagtcaaatcagtgaggaatagtagtaaaaattccctaagggtccaaaacagttggcacgaggcccaaatatggcattcagcccaaaatatggtaatactttccaaaacacactgatatcaaacagttttcaatcaaatacgcgacttaccagtcgtacgggacggaccaagtcacaattcccaacggtacacgacctcacacttgtcatctagcgtgtgcgtcacctcaaagtagcacgacgatgtgaaatccggggtttcatacccttaggacaaacatttacaatcattacttacctctttccggtccaaactctagaccgcgattcctttgccactcgaatcggcctccaaatgctccaaatctaaccaaaatcagtatattatcataaacatacactaaaggaacaaagcccaagcaaaaattattatattacatcaaaaatcaaactcaacccccggacccacgtctcgaaatccgataaaaatcacaaaatccgacaaccgattcaaccacgagtccaaccataccaaaattactaaattctgataacaattcggcctccaaatcttcaaatcttattttcaactctctaggtctaaatccccaatttacacctcaaaaacatgtaatctagtaggattattcgatgataattcaatattgtggagtagaaatgatcacaagtgactttcctcgagattttccatgacttctcgctcaaaaatcgctccaagccacattcttttcgtccaaaaatgtgggaatgagttaaaaaaacaagacagctcaataaaacacgattcgggtcgccaaaagcccctttcccgttgctacaagtgtcaaatctggtcggtaaaggtgccaccagatcctgctgcaccagcaatatttattttcagtaaaaaggctctaactctaccatacgaactcggaattcgatgattcttgttcctatgagtcacaaataataatatgaacatagacctataatcttatctcaattcagagctcatttgctcagtgcgatatccatttctctcgttaaacaattaactcatgtttcccttcaaaaactcaatcgcgacttgatgaaattagaccaaacttttcagatcactcctataatccattatcaaaattccggaagtcttcaaatcaaatttcaatctctagaactaaaaatggacctttggatcattacatgcttatgctcaaaacagcaaaatcctccaaaaactcttccaaaatttatccgagcctcatgggaccccgaaaaatatggcaacacaccccataacatcattcaaacttgttccaaccttcggaacgctaaaacaacatcaaaacctcggattcaagcctaagaatttcaaaacttccgaattccgaattcgatcaaaaagtctatcaaacctcgtccgaatgacctaaaatttttcacacacgtcacaaatgacacaacggacctactccaatttctggaattccattccgacctcgataccaaaatttccactcccgaccgaaaaatgccaaattttcaatttcgccaattcaagcctaaatctaccacggacctccaaaatacaatccggatgcgctcccaactccaaaatcacctaacggagctaaccaaatcataaaaatccaaattcgtgatggaatactaaaaagtcaaaatttggtcaaacctttcaaatttaaagcttcgagttgagaattgttcttccaaatctattccgattatcctgaaaaccaaaatcgacgatttacataggtcataatacatcatatggggcttgtcatgcccgagaactggcgagcgaagtgcaaatgctcaaaacgaccgatcgggtcgtcacaagagcattgtcgcgaaacacatgtagaaactcattacctcgtaaacacctaaagaactaatcatatccttaccatgttgatccggcctactaccaagatatcccatctatccaaattccttctaattcaccttcaacttgatacttcttcttgccataacaccgcaatcctcgacccagaatcgccacacgagacccaagcataaagccacactgtcctatggttcataagccgctgactactctctcaaatatcccctaaagcaccacattcgaaatactttccctgaagagacttcctgcgaatctaaagtcattaccttcaccttcctgatattgatgtgtagaatccataatgatataaaaataccacgagtcttgacaccctccaatgcaaaccttagtttttatccaaatatacaacttgaaaatctccaattattacatgtaacatcttgaacccattaaaagcattctcaagagtcatccactctactcaaaccgcaattagcccgatcaaacggaccgatgatctgtgctcatgagtactccgacaccgcagaatgttacctcaccttaatgcaaccaagaaacttcctgttttatgcaccatacatcctttaccaataacaactcaatcattccgtgattctcatacacctataaagcataacataacttgtattgaaatttcctttactcgagcccttctcggtctcaacctccgtaagccataactaattcaccagtacgcctcaaactggaaccaacacttggctcaaaaccatagatcaaaacatgcaataactcataatgcatatactttatcactaccataataccttaatgagattaaactccatacttcataagctcttgcaacacagaccatctcgtacttcaaatcttctgcaaatctcacattcaccctcgcaacagtcaagcccactctcttaagcgaccaaaattcaaattgcatacatatgtttcactggtaaacgagatcttccaacaaacaataaaaggctcatacaaacttcagaacactctaaaggaggtaaccctcatactttgcctcaaactaatagctcttcatacccttccaccgtcataaaaattacgcaatcacttaaccttcctaagtctaaactcatatcgtaacatgaaatctactccactccccaactaaaaaacatgaaaagattcttcacacacctataactcggggctatacatcaagtcaagatgaaaatcaaacaccaattcacatctcactcatcacatagtcatccagccatcacttccactaatagggacaacactagacatataaatttaaaagcacgtgctcacataatcagtacctaagtactcaagctacaggcaaaacctgaccttaagtcctccagactgacccaatatcaacacacagaaatgacatctcacccctcgatcaggaaatcacaagccatcaatgcacagctgataccgagcgctcatgcgtgcatacagacgcatggaaggaattcaaagagttatatttcaagttgaatcaaggacgcatgatatgaatttaagaatgtgaattttttcctaaaggttctgcagcctcccgaggataagtacagacgtctccgtaccgatccgcgagactctactaaacctgctcatgactcattgttgatacccaattttttccctatgtatttttatacaaaatactttcaaaatagcatgtacatgcacatataagcatgccccaagagttttggtatttttttccaaatttttaagatttttgaaataaatttattatctattttagtagtgcaaaatccataattattcccaaaataataagttttggtgaataatttatttattcccatatttacaccaaaatatagttaatataatttttgtatattttcacaaatttatttggtattttagaagctaaattgcatataattgcaattatagcctactttaagattaatagcattttataattgtaaaattggtttcaatatttttaaattgatatttatatattattaatttcgtcagtacttttaattttcttttcaaatcgttttaactattttatataaaataaaaaggaaaaactggctatttaacatttagcctcatttcattgcaattatagcccattcggattttaattttagcctcgatttaaccccaaaccagttaacccaagacctaaccaaatcctccccagcctaatccttaaattaacccggcctagttccgaactaatctgagtcattgatcagataaaatcaacggcccagatccccctttccataattaaaccctcacctacccccttccccctgtctcattcttttgagactcctcgtctctctatctctcaaactctctcgaaggttcctgaaactctagcctctctcatcccattttcagcatccgactcaccggaatccatggcctctcaggccatggacgacctatactcacctcctccggctcttgtatgcttgatgctcgaaggatcgaggccagacctcgaaggtcttcactcataccttcaccgattcgaagattccgaccatcgtcgaccttgctccggtggctcttgttcttctgagcctgtttctgacctcatccgacttagatcggactttcttccaagcctttctcatttctagggtttctctgaaaccctaaggtattcgaggttctttccctctttgttttcttatatctatgctacatctatgttctactagatttttttctgactctttttttttgtgaatctgtctatgttatgtttgtatgttctcttttctacctagcatgttcttctcccgtatctttatgtttgccttattttgcatgttcttctattgtgctccgttctttcttctactggtttctatatcatgctttcacacgtttatcttatgtgttcatctacccctatgttcctttactgtattttctactaagctcttaatttttattttccttcttctggactttgttctttctaaacatgtttcatctactgtttccttaagtttacactacctctttgtcttctgaacttgtttaagttccaagcttttcttaaaacatgttctttatgcttcaaatcagctttttcactatgtttgtttcgaacctgctattttacctgtttgttttctcatgagtctctgaaaaagacctctgagcctgttttagttatttgtcttctcgtctctacatctgattcgagtcgaaaaccctaggatttagggtttttggcaaatttaatcacgtgctcggactagggttctattatggaaccctggattctctcaaactaagtttgagtctatgtactgaatttgagcctctttgtttataactctgaacttttctatactagattctttctaattatcatgacagttctttcttgtttgacatgtttgtgtgctttatatatgaggaattctttcttcaaaaggggtttttccaactactaattgattgattctgaaatcctctaatgggtttgattgattgttactaattatctttgattaaacctttcttcaccttttctggttgggttcattcataccaaaactcaaattctgattctactgattgttgattgattgcctttccttatttgcacaaaccgtgttgctatcaaactctttccttaaatagttcctatgtattttcccttcttgtactactttggaaaagattatgatcaaattctttccttaattaccttctacccgtttgaaatcaaatcccttagctgaagggaaattctatgtgattgattgtaaactattttcttacatttcttacttgcttctttgcactataaaatggacaattcaatactttttacaagacacttcgaattgcatactattacacactactactactttcaaaacctgcattccctcttactctcttctctactgttgttctctgcccctgcttattattaactgggtgaaagtcaaggctaatatactactactactttgtctttgcatcctgctcttgctcttttacgggtatgtcttgattcagtccctagaaatcatcctaaggtgtttacttagaacctttatatctatgcctattacctgcaaagtttgacatgttcatatgctgctgtttgttttactttcttgtgaatgcttgatccctatacatttaccctctatgtgtttgtaaatggggattcagggcatggaaacatgagttattgtccatgaacggaattttaaccccaagtaaagggtgtcagtatgttttattgctgatcatgtcctttgcccacttttcctttgtcaactgtttctattatgaatcccctacccttatcccctatgtatgttgagttaaggctcatgatctggtagcctcttaaatggctgcccagtcctgagcctgggtttcaataagccctaactactctacttgaaatgacaagttggtcaggggtgtaccagtacttcaagttgcttggcatgaccaccagcttatcacttcccctcccctgcacttgcacctactcttagattttgagttatgcccccctcctatgagccttgctttgggaccttgagttccctctgaacttggtcatttgagggctggcccttccacactgcactatgtccttgattctgaaatatatttggggtgtaagcattgcccggagcccctttgagactcttgtgaactttgacacatcccaaataagagaaaggctttggaacttgatctttggagttggtttacttcatgcttcagacagaagtacgaatcatgctctccttggttgggacttttagttttctgatgtaatttttattttatttttcttttatcaattctggtttgtaataatcttgtaataaacatttggggtcggctagtgaaaaagggtggggaactatgcatgcaaggggtagatatcatgcctataggggttattatttataaaattctacatctcatctagagatcatgcctataggaattgatatgttttaaagttctgtattttataaatcattgaaactctgtattctcacatagataccatgtccataagatttttggcattctcatatagacaccatacctataagactttatgtattctgcatatgcatctatcattaggcaaacgtgtatataggtttaaataacaatcagtattttagacaccaggcctataggacttctgcacttctataaacgtttaaaatcagtaactcctagatatcatgtctataggattcttgcaactgtttaagatcaatgacacttagaaaccatgcttataggatcagttaattgaatcagcctcgtttcgaatctaaaactcgtcttaaaatctgcagatccctttttctaaaattagtaaagcttttccttaaaatcagtatactttgcattattagatatcatgcctataggtttcacctaggcaagctttagggtaaaagccataagtgcatcaatctttgacaattctaaccagcagctaggtctgattcagatttcttatctgaagtatgtaataaatcagtctacctcacagatttttttaagtttaattcagacctaatcagtacatgtaatacatgctaaactctatgcttttctgacttgaggaagtttatttgagcctttaaactgttttgtgttttcccatatctgttttatgtgttttgtttgtcgccctagaattttatccttttaaaaccataaaatccccaactccctccccttcaggattagtagtctcaatgcctccgagcttgataggattgggacgggtaatagcatgcaataagtaacgataccattccgcgctttaataccttaatggggtgggaagggtagaatatgaatatgatgaccggtgtgctaatatcacgtgcaacccctcttctgagaagtgattgctggatattgcattgaagtgatccatattaatcacaaacctaggacccccttttctttattcacttcctttaaagttgtttaaacttttcaaatccttgctctttttctacttacttttataagtttcaacctaattgcaatgttgtatgcaagtccttatttgagccttgattgtttacttgtaaagtcacaattgtagcatggtcgggaaccacacttgtggatcttgaggggtgcttcccctcgggataatttctagccattaccctaatctctagtctcttcatctcaaactcttctaaaaagtgtcctaatgcactataatcattatgtggcgattcttcaacttctaaacccaattctcgaaagggaatagagttgtcctcccaatgtcgtatacccgatttctgaccccacggttagagaaaaagggggcgtcgacagcatggcaactctgctgggaattctttaggcttttaccattgcatgttgcttgtgactttactatctcattaattgctttatttactatcttttattcgctacgaaactgacttggctcttcatgtcttttctttcctttagctaccttcctttactgctttatttcaatactgttgtaattattgcaattattgtaatcatttatcttatgaacgtgaaaatacatgttaatttgtttcattcttgtaaactgcatcttcaatatcatattccactcgtgccaaacaaataccatagcaacgcttataatgagtggttgcgctcttccaatattatcaccctttaaatttggcaaaggcgtatttgcggtaaaaccagtcgatcagcggtgcagtcaagggttctgtgcctttccatcttgagttgtcctctcaagggtacctgtctaataccccaatagaaaccttactctaactgtgcatgcatcatggtcaaacctagccgagtcagttatgttgtccacatatagccttgtccaaaggccattgggtttccctgaaacccaaacggacacctacatgttctgtgcatatatttggagaactaaatgttttttatgctaattattggtttaaatagtcgagtcgggaggggtaagggtctaacactctgttttgtagaaaataaggcacgaagtccccaaatttggcatggtaaccaacattcatccaagggtgttgaattggtgggaagatctccactccagtgattagacactcatccgcaaatacttagggaatctgccttctcttctagaaatccaacctaacaacaaaatcatagaggctgcaactctgttctgggacagtggcaggtccgtgtttcgcttcggggaccttgaaataactcctttgctcaaagaaataggaggcataactggcattccttgggagactccgggtttgcttatgccagaaaatcgcaagggtaggggtttccttaagatgatgggactgaagaagaacccagagttgacctatttgaaagactcctacatcccatttgactatctgtacgagaggtacaaccatagcaagtcataccgcacctactcagatgaatttgccctcacctcacttgggcatattcacaaaagggtcttcgtattcatgttttgtttcctgggaatgatagtgttccctatgaagaaggctaggatccacaccaaactggccatggtaactaagactctgatggaaggaattggcggacaacctttcagtatagtgcccatgattgttgctgagatataccgggctctggacaattgtcagcgaaaagcaagtcattttgagggatacaatttattacttcagctctggctcatggagcacctccagaaaggagaataccgacaagagatcttacgcagagactgggatgatcacattgccttccaccagccaaggcgtatgaattatatgcctaaaatgttcgctcagctagaagatgctggaagatgggtgaagctatttgagaatctaaaagaagaccaggtactgtggatggtcgaatggttccctatggaagaattcattgttcgatcccgagacgcaccatttctcatactcattggtctaagaggaacttatccctacattcccctccgagccatgaggcaggctggaaagaagcaaatcataccaagggtcgacaaaatgagtcactttagggctaatttctaggacgatgatatccctcacaaatgccaagctcaacacatgtggcattgcaagctcgttttggggaaagaatctattgagccagacaggtatcacgctggttgcatgccgcattattcgggttggttggaagataatcacaatggtatgtgtcagcccgggttcattcacgaacacagaatcatcgacgagaaagttgaagcacgggttaagtacaatcaactgcgcaagagaattcgagagtgttaaagtgagcatcgagaaatacaagaagcccatcaaaagttgatcgaggaatggaaggatatagatgtcagcactaacaagcgactagggcatttggagcggggtctagtggagctagaaggaaagttcctcaagaggattgaacattgtcgaaacgctgaagggaatgcaggcggacatttggcccaagcttatatgctgttaggactgcgtgagttggtgaagctgttcgtgggggataaagctaccaaatctggggaaggtccttccgggaccaagtagttaggagtcttttattttgcttttaatgatgtaataaggtcgatggccactagtgacattttattttctgttatttagagtcattttggatttgtcttatttttattaataaaataaaacatttagcattataagttctccaagttaatttgtcgctaggcctacctcgggcacaatgaggcacccaaattaggacgcgatttatattcttgcacaatgtgtttaaatattgcaacattttttcttcataatctgcactaacttgttaccttttttgtttttcttttcttttattattcccctccacaaaggttagttcgtgcattctggcaccatcatcatacagtacgaggtccaagggccctccttctccccctcctccgattcctatccggaacaaggacaaaggtagaatgggatattcaagcgccagaaaggaaattgaaagaattgagattcctcagggtaccccggttgctaaggaaactgctgcccaacttgagcaaaaaatgttgaagttccaagaagaactggatcaagttcggaacttggcaaatttatcattcactctcaccgctcctgatgtcaacttttcaaatactcaaaatcccgcacctccacagaacaccccacaaccacagatgcaacccactcatattcaacattgcaacatatgtcacactccactacccattcctgaaccactgaacaccacaaacgaccacccccacaacactcccatctacatagataccataccccactacactcaaccaatctcaagtgcacctgagtctgatgacaaggactctcttattagaaacttggtggcagaactcaagaaattgaccagccgagtctagggcatggaaggaaacaaaggcatagaggggctgaattatgaggacctctgcattaagccagatgttgaacttccagagggatacaaacctcccaagttcgaaatgtttgatggcatgggagatcccagagtccatttgaggacatattgtgataagctggttggagtcggaaggaatgagaaaattcgtatgaaactcttcatgagaagcctgaagggggatgcttcatcctggtacatcagtcaggaccccaagaaatggacaagctgggtaggtatggcatcgaatttcatggataggttccgattcaatacagagaatgcaccggatgtattctacatccagaatccgaagaagaagcctaccgatacattccgcgagtatgctactcgttggagatcagaggctgttaaggtcaggccgtccctagaagaggaacaaatgaatagattcttcgtccgagctcaagacccacaatattatgagaggtttatgctaatcgagggccagaaattctccgatatcgtcaagatgggcgaaagaattgaggaaggcattaagaatggtatggttactaatcttgaagcattgcagtccactaacaaggctttacagtctggtggcacgtcaaagaagaaggatgtcaatgccgtgatagtcgcacagggagccaaatcaccactaaaataccacacttacttgtcacctccacttacatatcaacctatcctgaattaccaagcacacacaccctcttaccaaaatcctccacccgtttaccaatcatctccacctctcacatatcaacccacttcacccagatactctcaacatgtacctgtttaccaagcttataatgcccaaccctctcactaccaatcacctcccactcgcctaaatttccctaaacccagaccaaattttgaccgcagaactcccaggcaatatacagccatcgctgagccaattgaccagttgtataagaaacttaaagctgctggttacgtctctcctatcccagccataactctagaaaatccttcccagtaggtcaaccctaataagacctgtgcgtatcactccggcatgaaaggtcacactattgacgaatgccgctctgatcgacaataaggttatcgtagcaaaggagactgctccgaatgtccgcaacaaccctctgcctgatcatagaggcggggacattcacatgattgagatcgaagatgactgggaccccgagggatcgataggactgattgctgaggataatgagccaaagaaaccatcagtcacacttaacccgattattatgcagaaccagtcctctaggggaaatgaagtaaacatgtctatgcctctcgaatttgaagaaccttcttctgcgaagctggccgggacaattgaggttgagtttggggctccaaaggcacctgtactctttgaagttgatatgttaccatcgagggtacccatccctgtagcaatgtcagacataacaccattccacttaaatgacataccatgggattacacagctgaagcaaagaggaaaggaaagaccaagatgaattattgtgcagggtatgaccagaacaggcagggtttacactctatagcacctagctgagtccagtaagcaagcctcgggacggactactgaaactggtcttgatgatatttggaggaaaatacaagctaaggattattcggtcgttgagcagttgaacaaaacaccaacatagatctccatcctagctcttctacagagctatgacgcatacaaaaaggccttgatgaagatattgagcgaagcttatgtgtccagcaacataactgggggcgaaatggcaaatatggtaggacaaatactggaaagccacaaaatcaccttctatgaagatgagctgccgccggaaggactgagtaacaacatggccctacatatcaccgttcaatgcgaggattactttgtctctagagtcttgatcgatggaggctccagcctcaacatttgtccgttgataactctcaggacattgggaaatagcatacacgagatcaaagatggggccatcaacgtcaaagcctttgatgggtcccaaaggtatactatcggggaaatcagcctatgcttgaaaatggggccaacctggttcgacattgactttcaagtgatagatgtcccagcatcctacaattttctgctaggacgaccatggatccatgccgctggagctgtagcatcgaccctgcatcaggcagtgaagttcgaatggaatcaccaagaggtgatcattcatggcgatggtagcaaccccatatatagtcgccagaccatcccgatgattggaggaagaaggaaaatagggggaaaaacataccaccacattgaaagagtcaacgctgtagacaaagataaatggtgggataacaagattgaaagtatcctgaattggtatggatacgaacctggaaagggactcggcaaaaccctccagggaatcaccaaacctatcaagctgaagaaacatggcactacattttgtttggggtatgagtacacttgggaggagttaaatcactggtcaccaccatggcacggtccctactacccactggagcatccgataccttacctaaagcagactttccagccggcagatattatatatgggtcgaaggaagaagaagcataggcagccgtgaagaatctgttcctggaggatgatgatatggactgctgtgttattttcgaggaggaaggggaggaaggcacttctatataagttgtgaaccgaggagagcacctcatcaattggtcaattagaaccaccagggaccgaaaagcttcggggtagcaaggctaaacaaaagcaccatgcatcacattttactttttactagatgattttatttccgcattgtctttaattctgaaaagagctttgatactcaaaacaattacaaatttaatcgaagcatttcagtttattatatatctcgctcttattatttttctatcattcactttattttacacaacattactattacttgccttgacgatgaaccaataattgtgacttgcaacgagacaatgcaacaaacggatacggactcagaagaggataatataccagaagaggtcgtcagaggagttgagaattttgaaaataggacaaagtctaacttggccgaaactaaggtcgttaatctggaagatacagggaatgtcaaagaaacgcgcatcagtgttcacctgtcaccatcagaaaagaaagagtacacggagttcctgaaggaatatgaagacatattcgcctagtcatatgatgatatgactggtctcaacacatccattgtagctcacaaactgccaagaaatccaacatgcccactggcaagctcgccaagtggcagatccttctaagtgaattcaacattgtttacgtgacccagaaagcaatcaaagggcaagccttggcggaccatctcgccgataatcccgtgaatggagaatacgagcccctaaaaacgtattttccccatgaagaggtatctttcataggagaagatattgcagaatcctatgatggttggaggttgtttttcgacggagctgcaaatttcaaaggagttggcataggagcagtcttagtatcagaaactggccagcactacccggtatccgccaagctcaggttcccttgcaaaaataatgtggccgaatatgaagcctgcatcttagggctcaaaatggccattgacatgaacgttcaagaattgctagtgatcggggatttagacttgctcatacattaggttcgaggagactgggcaaccaagaactctaagatacttccctacttgcatcatatacaggagttgaggaaaaggttcataaagacagaatttcagcacgtccccagagtccagaacaagtttgctgatgcattagctactttatcgtccatgatccagcatccagatacaaatttcattgaccctatcccagtaaagattcatgatcagccagcttattgtgcccacgttgaggaagaagcggatggaaagccatggttccatgacatcgaggagtacttgacaacaggggaatatccaggacttgccaacgctacttagaagcgcacacttcgtaggctatccagcaacgttttttcacagtagaggaatcctatacagaaggactcccgatttgggtttactaaggtatgttgaagcaaaaaaagcatccaggctattggacgaagtgcatgcagggacctgcgggctgcacatgaacggttttgtcttagcaaagaagatactccgagcagggtatttttggatgactatggaaacagactatatctagtatgttcgcaaatgccatcactgtcagatacacacagatatgataaaggcacctccaaacgagcttactacaacaagctcaccatggccactcgtcgctttaggaatggatgttatcggacctatcgagcctgccacatcaaatgggcacaggttcatcttagtggcaatcgattattttaccaaatgggttaaagcagcatcatacaaggcggtcactaagaaggttgtggcgggtttcgtccgcgaccgcattgtttgttggttcggagtttcggagtaaatcatcaccgataatggttccaatctcaacaacgacttgatgaaagcaatgtgtgaaactttcaagatcaaacacaagaactctacaacctacaggcctcagatgaacggagctgtggaagcagccaacaagaatatcaagaagatactaaggaagatggtcgaaagacacaaacaatggcatgagaagctatcattcgcctttttgggataccgcactacagtctgcacatcgaccggagcaactccttacatgctggtttgtggtacagaggcggtcatccccatcgaggtagaaattccctccttaaggatcatacaagaagtagaattggatgatgtagaatgggtaaaaggtcgctacgagcagttagcccttattgatgggaaaaggatgaatgcggtttgccacagttagttgtatcagaacagaatatccagagccttcaacaaaagggttaagctaaggaagtttacaccggggcagctggtgttgaagaaaatattcccacatcaagacgaatccaaggggaagttctctcccaattggcagggtccatacattgttcaccgggatctaactagaggagcccttattcttacagagatggatggagaagtctggccgaagccaatcaattcagatgcagtgaaacgatattatgtgtaaccacttatgattcccttaatgatgtaatttgaactacgcctcacccgattcccgtttaagaggggatacgtaggaagccctatgggttcggtcataatttaataaaaaatctattttccccgctattggaactggggcagaattttgaggaggaccctcaaaatttcgaggttaattttagttcatgcatcgccagaagcgccagcccagtaaactggggtagaattttgaggaggaccctcaaaattccaaagatgttttttagtcattcagcacagtcgtcagaaatgtccgctcagcaaactggggcagaattttgaggaggactctcaaaattccggagaaaaagaggctgcaatgtcttcaaccacgtcgcagtcattgattcatctaaagaaaactatttttgattatatatttactagagcatgcataactattatccgaattgctattgtttagcgatgctaccccaataacaaacaatgtcaagagcccagggaagacgaactaacctttccccttacagaactaacctttccccttacagaactcaattcgcaatatcattaggtatatttatgcactctcaagaatacaacttctcagaatcatcacttgtccacaatttctatccgtatacaatctccccagcagtcatattgtcgtaatcatcctcttgcactgcataaggctacctttctaccttccgaggttaagctctacctccatctgcatcgcataaggctacctttctgcctttcaagactaagctctgtctacatttgcattttgcataaggctacctttctgccttccgagactaagcaccgtcttgatatgcatttttgcattgcataagtctacttttctgccttccgaggttaagctctacctccatcatcatctgcataaggctacttatttgcctttcgagactaagcaccgtctccatatgcatttttgcattgcataaggctaattttctgccttccgaggttaagctctacctccatcatcatctgcataaggctacttatctgctttttgagactaagcaccgtctccatctgcatttttgcattgcataaggctacttttctgccttccaaggttaagctctacctccatcatcatctgcataaggttacttatctgcctttcgagaccaagctctatctccatctgcatttcctgcattgcataaggctaccattctgccttccgagactaagcattgtctccatcctgcatttttctgcattttgcataaggctacctttctaccttccgaggttaagctctacctccatctgcatcactaagctctgtctccatatgcattttgcataaggctacctttcttccttccgaggttaagctctacctccatctgcatttctctgcattgcataaggctacctttatgccttccgaggttaagctctacctccatctgcatcgcattaagctacctttctgcctttcgagactaagctctgtctccatttgcattttgcataaggctacctttctgccttccgagactaagaattgtctccatcttgcattttctgcattttgcatagggctacctttctgccttccaagactaagctctgtctccatcctgcatcggctgaaagattgccaccttatctttctcgcatggctaaaatatcgccatcttttatttacgtctggcatcggctgaaatatcgctgaatcctacatttcatggtctgaaagatcgccaccttctgcatttcatgggctgaaagatcgccaaattgtccaaaggtgtcattgttcggaggcaccatttgtatagcccgagaacgtcatgccatggcctgaggaccccattttatcttttgcatatcattattcaaaggcatcatagttcagaggcatcattctcatagcccgagaacgtcatttcatagcctgcgaatcctttatcatacgcttcatggcccaggacatcatggtccgaggacagcatcctacccgtctgaagatagcattcattgtccaacgggaacttgcatcacgtttaagtttatgcacgatatatgtttgtattgctcacttgcaggtacactgactatcaacggccatctcagcaggagcgatcccgctctggttctcgcagtctattagatttcaaccacctttcgcaacataaacatcgcgtctgttcctttcgaaaatctcaatcggcatattccatcaatggatcctgaactacatatggcctgattcctctgagaccagggatatgtaggcagcgcaggaaccagagctcggtcaaaactcctttcaaatcgccacttccggtcaaaattggtcatcttatctttacccgacaactctttcatccttaccgggtaaagagggccaactgttgatacccaatttttccctatgtatttttatacaaaatagcatgtacacatataagcatgccccaagagttttggtattttttcctaatttttaagattttcaaaatcaatttattgtctattttagcagtgcaaaatccataattatttccaaaatcatcagttttggtgaataatttattttattcccatatttataccaaaatatagttaatataattttttcatattttcacaaatttatttggtatttagaagctaaattgcatataattgcaattatagcctactttaagattaatagcattttataattgtaaaattggttccaatatttttaaattgatatttatatattattaattgggtcagtacttttaattttcttttaaaatcgttttaactattttatataaaataaaaagggaaaactggccatttaacatttagcctcatttcattgcaattatagcccattcggattttaattttagcctcaatttaaccccaacccaattaacccaagacccaaccaaatcggcccaacccaatccttaaattaactcgggccagttccgaactaatctgagccattgatcaaataaaatcaacggcccaaatccccctttccataattaaacactcacctacccccttccccccgtctcattcttttgagactcctcatctctatatctctcaaactctctcgaaggttcctgaaactctagcctctctcatcccatcttcaacatccgactgaccggaatccatggcctctcaggccatggacgacctatactcatctcctccggctcttgcatgcctgatgctcgaaggatcgaggccagacctcgaaggtcttcactcagaccttcagcgattcgaagatttcgtccatctccgaccttgctccggtggctcttgttcttctgagcctatttctgacctcatccgacttagatcggactttcttccaagcctttctcatttctagggtttctccgaaaccctaagctattcgaggttctttccctctttgttttcatatatctatgctacatttatgttctactggagttttgaaacgtttccccaatcttttctttcaaaatttgtttctcctcgattttgagtttctgaaaaaatcttaaaatgttttctgactcttctttttttttatgtgaatctgtctatgttatgtttgtatgttctcttttctaccttgcatgttcttctcccatatctttatgtttgccttattttgcatgttcttctattgtgctccgtgctttcttctattggtttctatatcatgctttcacacgtttatcttatgtgttcatttacccctgtgtacctttactgtattttctactaaactcttagttcttatttgccttcttctggactttgttctttctaaacatgtttcatctactgtttccttaagtttacactacctctttgtcttttgaacttgtttaagttccaagcttttcttaaaacatgttctttatgcttcaaatcagctttttcactatgtttgtttcgaacctgctattttacctatttgttttctcatgagtctctgaaaaagacttctgagcatgtttcagttatttgtcttctcgtctctacatcttattcgagtcgaaaaccctaggatttagggtttttggcgaatttaatatcgtgctcggactagggttctatgatggaaccctggattctctcaaactaagtttgagtctatgtactgaatttgagcctctttgtttataactatgaacttttctatactagattctttctaattagcatgacagttttttcttgtttgacatgtttgtgtgctttatatatgaggaattctttcttcaaacggggttttgtcaactactaattgattgattctgaaatcctctaatgggtttgattgattgttgctgattttctttgattaaacctttcttcaccttttctagttgggttcattcataccaaaactcaaattctgattctactgactgttgattgattgcctttccttatttgcacaaatcgtgttgctatcaaactctttccttaaatagttcctatgtattttcccttcttgtactactttggaaaagattctcatcaaattctttccttaattaccttctacccgtttgaaatcaaatcccttagctgaagggaaattctatgtgattgattgtaaactattctcttacttttcttacttgcttctctacactataaaagggacaattcaatactttttacaagacacttcgaattgcatactcttacacactactactactttcaaaacatgtattccctcttgctctcttctctactgttgttctctgcccctgcttattattagctgggtgaaagtcaaggctaatatactactactttgtctttgcatcctgctcttgctctttactggtatgtcttgattcagtccctaacaatcatcctaatgtgtttacttagaacctttatatctatgcctattacctgcaaagtttgacatgttcatatgctgctgtttgctttactttcttgcgaatgcttgatccctatatatttaccctctatgtgtttgtaaatggggattcagggcatggcaacatgagttgttatccatgaacggaattttaaccctaagtaaagggtgtcggtatgttttattgttgatcatgtcctttgcccacttttcctttgtctactttttttgttattaatctcctacccttaccccctatgtatgctgagttaaggctcatgatccggtagcgtcttaaatggctacccaggactgagcatgggtttcaataagccctaactcctcaacttgaaatgacaagttggtcaggggtgtgccagtacttcaagttgcttggtatgaccaccagcttatcactccccctcccctgcaatttcacctactcttagattttgagttctgcccccatcctatgagccttgctttgggaccttgagttctctctgaacttggacatttgagggttggcccttccacactacattatgtccttgattctgaaatatatttggggtgtaagcattgcccggagcccctttgagactcttaggaactttgacacatcccaaataagagaaaggctttggaacttgatctttggagttggtttacttcacgcttcagacagaagtacgaatcaggctctccttggttgggacttttagttttctgatgtaatttttattttatttttcttttatcaattctggtttgtaataatcttgtaataaacatttggggtcggttagtgaaaaagggtgggaaactatgcatgcaaggggtagatatcatgcctataggggttattatttataaaattctacatctcatctagaggtttatttgagcctttcaactgttttgtgttttcccatatctgctttatgtgttttgtttgtcgacctagaattttatccttttaaaaccataaaatccccaactccctccccttcaggattagtagtctcaatgcctccgagattgataggattgggacgggtaatagcatgcaataagtaacgatacaattccgcactttaataccttaacggtgtgggaagggtagaatatggatatgatgaccggtgcgctaatatcacgtgcgacccctcttctgaggagtgattgctagatattgcattgaagtgatccatattaatcacaaacctaggacccccttttcagtattcgcttcctttagagttatttaagcttttcaaatccttgctctttttctacttactttcataagtttcaacctaattgcaatgttgtatgcaagtccttatttgagccttgattgtttacttgtaaagtcacaattgtatcatggccgggaaccacacttgttgatcttgaggggtgcctaacaccttcccctcgggataatttctagcccttaccctaatctctggtctcttcatctcaaactcttctaaaagttgtcctaatgcactataatcaataggtggcaactcttcaacttctaaacccaattctcgaaagggaatagagttgtcctcccaatatcgtatacccgatttctgaccccatggttagagaaaaagggggcgtcgacactcatgagacctatgtaacctaggctctgataccaacttttcacgacccaaaaatcgacctagtcgtgatagcgcctatcatgaaactaggttaggtgacaatactcccgaggtttaaccatttaatcaatattagtcatttttaagcctttaattaatcaaatatctcataagataactctaaatgaacagtgtgaaataaatacacaagtctgacattgggatgtcacaagtcacgagcatctactaaggtctgaatacaatgaagagtctaaaaatatcctaaatacaatataaggaagataagagggagaaaagcagtgctgcgaacgtcgggcaactatcttgctaactccgatgactctgccactgagcaatcaacacccgctacaaggtttagaagttcttgaatctgcacacaaggtgcagggagtattgtgagtatgtcaactcagtaagtaataaaagtaaatgaaagctgagtagtaagaaaatacgtaaaagacaacataacgcgacagcaaatgcagtacatttccaaaacaatacagaaatcattttctttgtaaatcaagctcagtttcagtaaaacctttttaaacaacttccaacagtttcaaacgagtgataaaaatagtgatttaaaacgatagaaacataaacagcccctcgagcaaaatatgtaccataaactacccttcgggcttaatatcaatagaaccagccactcaggctacctcacaatcactcgtaatcagctcctctggcataacatgaatcaaaaaccgtccctcgggcaaaacatggatcaagaatagcccttagggtaacaatatgaaacaacaacagcccctcgggttaaattatatcactcacactgggtacccgctctcactgggggtgtacaaactccgggaggggccccctacggcccaagcgcaataacaagccatatcgtggcatagtcaaactggctctcggccttatatcaagcttgtggcgtaacaaatcaggccctcggcctcataatcatgaatcaataaaacactgatgtggcgcgcagcccgatcccacagtatcctcacaacacaggccatcagcctcactcagtgagaaatctctcaagctactccagcaacaataaaacatgatgctcagcccaaaatatcacttaaaatatcaaaaacggagaaaatatggatgcgttatgaaaatagttgaatacaacatgactgagtacaaatattaagtcaaaacaatgagaaatagtagtaaaaattccctaagggtccaaaacagttggcacgaggcccaaatatggtattcagcccaaaatatggtaatactttccaaaacacaatgatatcaaatagttttcaatcaaatacgcgacttcgcagtcgtacggggcagaccaagtcataatccccaacggtgcacgaccctacgctcgtcatctagcgtgtgcgtcacctcaaagtaacacgatgatgtgaaatccgaggtttcatacccataggacaaacatttacaatcattactttcctctatccagtccaaacattagcccataatgcctttgcccctcgaattggcctccaaatgctccaaatctaacaaaaatcagtatattatcataaacatacactaaaggaacaaagcccaagcaaaaattatcaaattacaaatcctgaaattggccaaaccagacccgcgagcccatgtcttggaatgcgataaaatcacaaaatccgaaaatctattcaaccacaagccaaaccataccaaaattactatattccgataacaattcggcctccaaatcttcaaatcttattttcaaattcctaggtccaaatccccaatttacacctcaaaaacatgtaatctagtcggattattcgatgataattcaatattattgagtagaaatgatcacaagtgacttacctcaggatttcccatgacttttcgttcaaaaatcgccccaagtcgcgttcttttcatccaaaaatgtgggaatgagctaaaaaaacaagacagctcagtaaaacatcattctggtcgctaaaatccccattcctgtcactaaaagtgcgcaccagatcctgttgcaccagcaatatttattttcactaaaaaggttctaactccaccatacaaaatcggaatttgatgattcttgttcctatgagtaaaaaataataatacgaacatagcccttcaatcaaaacacaattcggacatcattttcttagtatgatacccattttgctcgttaaacaattaactcatgttttgcgtcaaaaacccaatcgcgacttgatgaaattagaccaaactttccggatcactcctataattcattatcaaaattccagaagtctcaaaataaaatttcaatctctataactaaaaatggacctttggatcattacatgcttatgctcaaaacggaaaaatcttccaaaaactcttccaaaacctatccgagcctcatgggaccccgaccaaacatgccaacacaacccataacatcattcaaacatgttccaaccttcggaatgctcaaaacataatcaaaacatcgaatcaccctcggattcaagcctaagaatttcaaaacttccgaattccgaattcgatcaaaaagtctatcaaatctcgtccgaatgacctaaattttgcacacatgtaacaaatgatacaatggacctactccaatttccggaattccattccgacccgatatcaaaatttccactgccgaccgaaaaacgccaaatttacaatttcgccaattcgaaccaaaatctaccacggacctccaaaatacattccggacgcgctccaaagtccaaaatcacctaacggagctaaccaaattatagaaatccaaatttgacttcgaatactaaaaagtcaaaacttggtcaaaactttcaaatttaaagcttcaggctgcgaattgttcttccaaatctattccgattatcctgaaaactaaaatcgacgatttacataggtcataatacatcatacagggctattcatgtccgagaactggcaaacgaagtgtaaatgctcaaaacgaccggtcgagtcatcacaatatcatgtcgaggtcgtatggcccgatccaacataaatgtaaaatgtgcactgccgagagtcgaacggcacgaactatagatgcatctattaccccgctcgtgaatcatacatgtgacgcgggcacacatagatacacccattcaaacagctaattaagaaattatcggggaacatttatccaaataaaagtcaattctcttttactgatttaagaaaatgaagttttaatccttttagaaattcatttaccaattcaataggataagcaattcaactatcaataaaattacaaatattctaagtagagcatgcttttgggtcctagactacccggacttacacataatagtagctacgctcggactctcgtcacctcgtgcgtacatagcccccacaaatagaagcacataaccaattatttcaccaatgaggacaattccctcttacaagtttagaaaagagactcacctcgctatgaagatccataaccggcattcatcgcccttacgaagactcgaatcaatgcacaattctccaaaactagccaataattattcaaatccattaatgtatgttcaattactcattacaatccaatttataacaattcctaacccgatcaaaaagttgacaaaattgccctcgggcccgaattccgaaatttttcgagataaagtttatccatgaactcacgaactcaaatatatgatcttttcttaatttcataccaaaaattgtggtcaaaatccaagaatatcaattttctaggttttccctcaaaccccaagtttctaccaattttcatgctcaaatccgcacacaatcaataatttaactcaagataggtggggatagcttaccatgtcgttgatgatgaataccccctctagaaactttcccaaattgtccacaccaaatgaaaatggggaaaaaatgaccaacccccgacattaaaagaatacactgcctccaacctttccgcacctgcggtgcataagccgtacctgcgaccatcgcttctacggtgcatgtgccacttctatggtcccagggccagggccaaaatccgcttctgcggtctcctcaatacaggtacgttcccgcatatgcggttaaagcatcgcacctgtggtcattgcaccgcttcgcccaaacagcatatgcgacccccttggccacttctacggctccgcacatgcggccaagacctcgcaggtgcggttacaccatatatcagctgcctcaattcttcctcaaattccaatattgatctgttaaccatccagaatccacccaaggcccccggggaccccaaccaatcatgctaactagtcccaaaacacattacgcacttgctcgaggtctcaaatcatatcaaatagctcctaaaccattaatcgccctccaatcgaagcttaatgaactttagaatttcaatcttcaacattcgatgcagaaacccatcaaattacgtccgattaacatcaaattttgcacacaagtcacatttgacatcacgaacctactccaacttccagaatcggattccgaccccgatatcaaaaagtccacttccagtcaaacttctcaaaaaccttcaaatttctatctttagccaaatgactccaaaatgacccacgaacctccgaattcactttcgatcgcgctcctaacaccagaatcaccatacggagctaatccagactcggaatctcaaacggacatcgataacactaaaatgcacttcaacccaaacttatgtaattcgtccaaaaatgctaacttcaacaataggtgccgaaatgttcccgggtcttccaaaatccaatccggatatatgcccaagtccaaaatcatcacacgaacctactggaaccttagaatccccattttgagatcgtttactcataaatccaatattagtcaattctttaatcttaaagcttccgaaaagagaattctctttccaattcaacaccgaacttcccgaaattcaattctgaccacgcatacaagtcataatacctgaagtgaagctgctcatggcctcaaactgctgaacgccgcgttagagttcgaaacgaccggtcgggtctttacattctctcccacttaaacatatgtttgtcctcgaacgtgctaagaactgcaatggagttgtccgaaatcactttttaacaccttaagcacctacccgtgctaccacaactcaattgggcaccctagcttgatcaatctgaagattccctttttcacttaagaaaataagtcttagagcccaattccaacatccagaattctctgccaggcttgtttctaacatacactcaccatatcaatcactacacgtagcactaaaacatgactgcatacctctactgaattcacaccttgcatcactttactcacaggaccacaataacattctctgatcaaactagtcgaaattccacgaatctgacactcccaatgcatcttaatacctatatacatattgctctgattcttacaataccaccatgacggaagatgcacgtagaaattcataaccaactgtcgaatacaaatcattgggactatacttatgacaagaatcattacctccttctgaaccaaataatggaatttactctttaataatgttcaaataatccgattgcactgatcttggttccaataatctcatctcaccgtacgaactgctcaggcaataagccacccaaacatgaccaaaagtctcatatgatgccgcaatgtgccaataggctaccaactcgaatgtgatacacaaggaagacgaactctggaagggactactcaactcacacaactgccatgaactttcctcaaaaaatgaaaaacaaacacacaaaaacaaaatatagaaactgtactcaacatcacattgttgcggcgtgcaacccaatccaaacaacatacctatggcggtgtgacacccgatcgacacataaaattcaaataaggagatacacacccaactaaattgctcattacaacaaaaataccgaatatcggtcacaagcatgctaagtgcttaataccatccctaggagacatatagcgccataagctaacaaactcaagcacagctgaggtgcgatatatgattagaatctcaagagtcatcctgctcaaataacaccatcactacgtggaacctcaacacataagaaatttatccagccattcacaactcacacgacacagtattgcattacaggaaatagccgacggcgatataacatccaacatctgaatactcttccataaggagaggtaggctgaaatgacacatttggcctgatgtagtgcccacattcatatttaaatccacccacggatctcaggtcgattttgatcgtaccaaactaggccaataacacacaagaaaaaccatcataatcggggcaatcctccacagttcacaacctaataagtcgagtgccctctaggcataaattctcaaattaatgatgtcaccactatcttcatacttggtttaaattcgttaatcaatcaagttactacctaccacccttatacaatattcctgtggggcacgctctcacgaccttccgtaacagacaacaagtctgagcatccataccaccagccgcactaatgctgagaaagcgttcaagaatccataactaggatgcaaagccctttaaacaccgatcttaggtgatgctgaagacaatgccagcttactttaaacattcaaatacctttcctgctcatccgagctcgtgacatccttgtcaataccgaaccacaaccttgatcctcacttccaaatcccataacactcactacacccaacatgccaatatacaatagaacatgattttcatcataactctggaaccactaatatcttaacacttcatcatatagaaacttttaacttaactcacttcaggagaaccatagcaacacacatgtgaatcctcataatcatagaatatgcaaatcgtcaagtagtggtctaagccaccatagcacttccgggatccgcctacacataacaggccataacactggaatactcccaaataaaatcaattatggcggccaacaagcctcacacgtaccgccacaaatcacttgcataactcaatcacgctaaaggaattgatccctgccaccagtataccaattcaaccatggtcaaccaatccaatttcttctaattcatcactaacttggcttatagataataatagctcaattccatacataaccaaccaaaatccgcacccatcttgagcgactccattctacgagaccaaattgtctccaaaccaatgaactgtttcataccctcattgcacacacattcgcatctacaactaatacacccattctgataacttctccacgaatccgaagtcttttgctcatttttctcctaatgctacactgcaagtcgaacatatcatagaacattctgagcctctcgccatcatcttctacataagctcggtttttagtcgtacttataggatcgaaatcattaggcaccacaccataacttttgaatcactaggaccgttgtggagagccacccactctgacttggtgccgaatataatcaactccatgaatcttctagcacatgaacaccttctcgatgaagcacccagctgaatcactttccttgaaactcgtatctatacaaggcataaatattgaatccttccccaagtctaaacatgtgtcaataaggccaaccataacacacctttaacaattcctttactcaaattacctcttattctctctctcttagctgaaataactcatcaatatgctaataaatggaaatctcgtaaataagagaccatgaattcaaaccgtaggcagtggaatctccctcttagcttgaagccacaattaaacaactctggagcccaccaatattctttatctcttattgacatgaccttgcgcaattaaactgccagactccttgaaatccttccattagcacttcatgaacactctgaatttccatcaatatacacatattcgacctcttatcggatggccaataaaatccttcgcagaagcttcgccaatcacacgaccgctaacctgctcacagggaataacccacctgtggaaattacctacctcatcttccaacgtcactgcactggggtacaattactacgacatcaataatccatcttgagctcgcgctcacccaccaactacacaagtccattcactcctcgtggacattaactaaatgtatgacaatatcttccaattcaaaattatgttgtatccttcttcatatcaagcagctcctttccgtcatatcgaatctcccgcggttatgctagttagtatttcaaattaggctcgtaaacccaattatcgtccactaaaattcccccaaatcattccaaactttacttaaggtgcgtaatcatcctaccactagacccatatgctactccgacactctcccactttggcgaaacccgcacctttaatcaactactcaaccttcgctactgatacttggctgccttaaaaattcaaccatcgcatgacacctcccacatgtacttcctcatccttcgctgcccaattattgccttaaataaaatctatcttcgtagcacttgcacccacaaatctctactaactttaaacctttccgaagatcatctttctcgagccgtcaacattggaagcatcgattcaatcctgaaccactgcaccccgcgatctctgactgccgcttctcaaatactatttcacaatatcctaccccaaaagaaaattgcagaaggccataacatcggctaacttaatgcattcaatcgaggaagacaacaccacactgtagatgaaaattccaccacgctcgaaaataccaagtctcttacttcctctacccaactctggacgttcacgggccaattgctttttctccaccggaaataaaataccgaacctctgaatcatacactgagtagacctccattcaggtcattcaccacccaacacatggccaagaaccttaccaacaggtcaatactgtgcaacaaccgatcatgagcaatcatagaaagctgcgcatagactcaaagctctcaggaatactattactgagctaaaatgacaggatatccctctgcaaggcaacgacaatagcccaatcaactatgcagggagaaacatcccgcaccacatcaatagtaacattaaaattcttcaattctcgatttataataagcgcttcacatcacataatattaagtatgaaggaaacaagggcataagcctcaaggaaacaaattgcacgatgaggaattaagaaggaaggtgttcctaccagtcctatagcctctcgaggataagtacaggtgtctttgtaccgatacgcgagactctactagacttgctcatgactcatgagacctgagggaacctggtgctctaataccatgttgtcacgacccaaaatctactaagggtcgtaatggcgccggacactgttattaggcaagccaaccaaaatacttaattaaattcttgttttaataattttaaaaactatgattttccttcaaattgtactagtaaaaggtaaactttacaatataaataaaagaatgtttagaaataaatacaagatacccaagaatcatcccagaacccgtgtcacaagtgcatgagcatttactaggaatgaaataaaatacagtaaatatccgaaatacaaagtggacagaaatgaaaataaagtacaacgctctgaaggggactcagctggtagcgggtcgtctcgacaaatgtagctcacctaagtctctgtatcaaccatgccgctatgccactaagccagtatccacacatgaacctgtgcaacaaaaatgcacggcaagtatagtatgagtacgaaaacaacgtgtacccaaagagtatcacggtctaatctcgaagaagtagagacgagaggtcgacttcgacacttactagtggtccaatgataatatagtgaaatgtgaggagattatggattttttataaaacaatcaattataattcataaagccagatagtaggtaacaacttcccaaataataatggatttccaaataattacttttcatcttctttatcaattaatctcaggccagggaagtaaaatatcaacatttataaatctcaggcaaacagtacaagcatgcgcatatcatgtcgaggtcgtacggcccgatccaacataaatataaaatgtgcactactggtcgaacgacacgaaccatagatacatctattaccccgctcgctaatcatacatgcgacgcggtcaacataaataaacgaacaccacgctcgcaaatcatacatgcgacgcaggcacacatagttacacacattcaaacagctaattaagaatttatcgaggaacatttatccaaataaaagccaattctcttttactgatttaagaaaataaagttttaatccttttagaaattcatttaccaattcgataggatttaagcaattcaactatcaataagattacaaatattccaagtagagcatgcttttgggtccttgactacccggacttacacataatagtagttacgtacgaattctcatcaccttgtgcgtacgtagattccaaaaatagaagaacataaccaattatttcacctatggggacaatttcctcttaaaaggttagaaaggagactcagcttgctccgaagatcgaaaaccgacattcctcacccttcggaagactcgaatcaatgcacaatgctccaaaactagccaataattatgcaaatccattagtgtatgttcaattactcattacaatccaatttataacaattcctaaccccgacaaaaagttgacaaaatcgtcctcaggcccacgtgcccggattccgaaatatttcgaagataaagtttacccatgaactcacgagctcaaatatatgattttctcttaatttcataccaaaaatcgtggtcaaaatccaagaatctcaattttctaggttttccctcaaaccccaagtttctaccgattttcatgctcaaattcgcacataatcaatgtatttaaatcaagataggtggggatagcttaccctattgttgatgatgaaaaccccctcttgaaactctccaaaatcgtccacaccaaatgaaaatgggggaaaaatgaccaacccccaacattaaaagattacactgcctccagcttttccgcacctgcggtgcataagccgcacctgcgaccatcgcttctgtggcgcacgtgccgcttctgcggtcccagtgtcagggccaaaatccgcttctgcggtctcctcaacgcaggtgcgctcccgcatctgcggttaaagtaccgcacttgtagttagtgcaccccttcgcccaaaccgcatatgcaactcccttggccgtttctgcggctcccaactgcggccaagacctcgctggtgcggttacagcagatatcagctgcctcaattcttcctcaaattccaatattgatctgttaaccatccggaatccactcgaggccccccggaccccaaccaatcatgacaactagtcccaaaacacattacggacctgctcgaggtctcaaatcatatcaaacaacacttaaaccatgaatcgctctccaattcaatcttaataaactttagaatttcaatcttcaacattcgatgtcgaaccccatcaaatcacgtttgattgacctcaaattttacacacaagtcacatttgacattacagacctgctccaacttccgaaatcggattccgaccccgatatcaaaaagtccacttccgatcaaacttctcaaaaaccttcaagtttctatctttagccaaatgactcaaaaatgacccacgaacctccgaattcactttcgatcgcgctcccaacaccagaatcaccatacggagccattccaagactcggaatcccaaacggacatcgataacactgaaatgcacttcaacccaaacttatgaaattcttccaaatatgctaacttctacaataggtgctgaaatgatcccgggtcttccaaaacctgatccagacatacgcccaagtccgaaataatcacacgaccctgctggaaccttcaaatctcgatttcgaggtcatttactcaaaaatccaatattagtcaattctttcaacttaaagcttccgaaatgagaattcgctttccaattcaaccccgaaattcaattccgaccaaacatacaagtcataataccagaagtgaagctgctcatggactcaaactgctaaacgacgcgttagagttcaaaacgatcgttcgggtcattacattctctcccacttaaacatacgttcatccccgaacgcacttagaactatactagagttgtccgaaatcactgtttaacacctcaagcacctacctgtgctaccacaactcaactgggcaccctagatcaatcaatctgaagataccctttttcacttaagcaaataagtcttagagcccaattccgacatccgaaattctctaccaagcatgtttccaacatacactcactgtatcaatcactacatgcaacactaaaacatgacttcatacctctactgaattcataccttgcaccattttactcacaggaccacaataacattctatgatcaaattagtctaaattccacgaatttgatgctcccaatgcatctcatgacctatatacatattgctctgattcttacaataccaccatgacggaagatgcgagtagaaattcataaccaactgccgaatcaacaaatcattggggctatacttatgacaagaactattacctccttctgaacgaaataatggaatttactctttaatattcttcattaatccgattgcactggtcttggttccgataatctcatctcacccagtacgaactgctcaggcaataagccacccagacatgaccaaaagtctcatatgatgctgtaatgtgccaatgggctaccaactcgaacgtgatacacaaggaagacaatctttggaagggactactcaactcacgcaactaccataaactttcctcaaaaatgaaaaacaaacacacaaaaacagaatatagaaacttactcaacatcacactgttgcagcgtgcaacctgatccaaacagcatacccatgttgctgtgccacctgatccacacataaaattcatatacggagatacataccgagctaaattgctcattacaacaaaaataccgaatattaccatccctggggagacatatagtgccataagctaacaaactcaagcacaactaaggtgtgatatatgatctgaatctcaagagtcatcctgctaacataataccatcgctacgcggaaccacaaaatacaagaaatttatcgagccgctcacaactcacgcagcacaatatagcattacaggaaatagccgatgatgaaataacatccaacgtctgaatactcttccataaggagagttatgctaaaatggcacatctagcttgatatagagcccacattcatatttaaatccacccacagatctcaggtcgattttgatcgtaccaaactaaaccaataatctttcctgggtccataacaaccccgtcttttcccaaaacacacaagaacaaccatcataattggggcaatcctccaaagtccacaacccaaaaagtcgagtgacctccaggcataaaatctcaaattaatgatgtcaccactatcttcatacttggtttaatttcttcaatcaatcaagtgactacctgccacacttatacaatcttcccgtggggcacgctcccatgaccttccgtaacagccaacaagtctgagcatcaataccaccagccgcactaacgctgagaaagcattcaagaatccataaccaggatgcaaagccctttaaacaccgatctcaggtgatgctgaagacaatgctagcttgctttaaacattcaaatccctttcctgctcatccgagctcatgatatccttgtcaacaccaaaccacaaccttgatcctcacttctaaatcccataccactcactgcacccaacatgataatatacaatagaacacgattttcatcataactccggaaccactaatagcttaacacttcatcatataaaaactttcacttaactcacttcaggagaaccatagcaacacacaagtgaatcatcataactgtagaatatgcaaatcgtcaagtagtgatctaagccaccattgcccttctaggatccgcctacacataataggccataacactggaatactcccgaattaaatcaattacggtggccgacaagcctcacatgtaccaccacaaatcacttgcataactcaatcacgctaaaggaactgatccttgccaccagtatgccaattcaaccatcgtcaaccaatccaaattcttttaattcatcattaacttgccttagagataataatagctccattccttacatcaccaaccaaaatccgcactcatcttgagcgacttcattccacaagaccacattttctccaaacccatgaactgtttcataccctccttgcacacacatttgcatcttcaactaatacactctttctgataacttctccacgaatccgaagtcttttgctcatttttctcccaatgctacactgcaagtcaaacatatcatagaacattccgagcctctcgccatcatcttctacataagcttggttcttagccgtacttataggctcgaaatcattaggcaccacaccataacttttgaatcactaggaccgttgtggagagccacccactctgacttggtcccgaatataatcaactccatgaatcttctagaacatgaacaccttctcgatgaagcatccggcttaatcactttccttgaaactcgtatctatacaaggcataaatcctgaatcctcccccaagtgtaaacatgagtcaataaggtcaaccataacacacctttaacaattcctttgctcaaattacctcttattctctctcccttagttgaaatgaatcatcaatatgataataaccggaaatctcgtaaataggagaccatgcattcaaaccgtaggcggttggatctcccacttagcttgaagccacaattacacaactctggaacccaccaatattctttatctcttattgacaagtccttgcgcaattaaaccaccacattacttgaaatccttccattagcacttcatgaacactctgaattaccatcaatattcacatatttgacctctaccggatggccagtaacatccatcgcagaagtttcaccaatcacgcgactgttaaccttctcacaaggaataaccaacctgtcgaaattacctaccgacatcttccaatgtcgctgcacggggtacaattactacgacatcaataatccatcatgagctcgcgctcatccaccagctgcacaagtccattcactcctcgtggacattaactaaatgtacgacaatatcttccaattcaaaattatgttgtatccttatttatatcaagcagctcctttccatcatatcaaatctcccgtcgttatgctagtcaatatttcaaatttggctcataaacccaatcactgtccactaaaattcccccaaatcattccaaacttcccttaaggtgcatagtcatcctaccaccagacttaaatgcaactctgccactctcccactttggcaaaacccgctccttaatcaactattcaaccttcacttctaatacatggcctcgttaaaaactcaaccatcgcatgacacctcccacatgtaattcctcatccttcgttgcccagttattgccttaaataaaatctatcttcgtagcacttgcacccacaaataactactaactttaaacctttccgaagatcatctttctcgagtcgtcaacattggaagcaccgattcattcctgaaccactgcaccccgtgatctctgatagcagtttctcaaatactatttcacaatatcctgccccaaaagtgaattgcataagaccattacatcggcgaacttaacacattcaatcgaggacgacgacacaatattttagataaaaatttcaccactctcgaaaataccaagtctcgttacttcctctacccaactctggacgttcataggctattgctttttctctgtcgaaaataaaataccaaatctctgaatcatacactgagtagacctccatttagttcattcaccaccctaacatatgggcaagaaccttaccaacacatccatattgtgcgacaaccgatcatgagcaatcataaaaatctgtgcatagactcaaagctctcaagaatattgttactgagctgaaatgacaaaatatccttccgcaaggcaacgataatagcccaatcaactatgcagggataaacatcccataccacatcaatagtaccattaaaattcttcaattctcgatttataataagcgttttgcgtcgcataagattaagtaggaaggaaacaagggcataagccttaaggaataaaatcgcatgatgatgaatcaagaagggacgtgctcctaacagtcctgtagcgtctcgaggataagtacaaacaactctgtaccgatccgcgagactctactagacttgctcatgactcgtgaaacctaagggaacctagtgctctgataccatgttgtcacgactcaaaatccactaagggtcgtgatggcaccggacactgctgtcaggcaagccaaccaaaatacttaattaaattctcattttaattattttgaaaactatgattttccttcaaattttactagtaaaagacaaactttacaatgtaaataaaagaatgtttagaaataaatacaagatacccaataatcatcccagaacccagtgtcacaagtttatgagcatttactaggaatgaaataaaatacagtaactatacagaataccaagtggacagaaatgcaaatgcagtataatgctataaaggggactctactggttgtgggtcgtctcgacaaatgcatctcacctaagtctccatatcaaccatgccgctatgccactaagacactagccacacatgaacttgtgcaacaaaaatgcacagcaagtatagtataagtatgaaaacaatgtgtactcaatgaatgtcctgtctaatctcgaagaagtagagatgagaggtcgacttcgacacttactagtggtccaatgataatatagtgaaatgtgaggagatcatggatttttttttatcaaacaaacaattataattcataaagccagatagcaggtaaacaacttcccaaataataatggatttccaaagaattacttttcatcttctttatcaatttatctccagccagggaaggcaaatatcaacatttataaaatcttgggaaaacaatacaagcatatgcatataatgccgaggtcgtacggcctgatccaacataaatgtaaaatgagcactaccgagggtcaaacggtacgaaccatagatgcatctattacccccgctcgcgaatcatacatgcgatgcggtcaacataaataaacgaacaccccgctcgcgaatcatacatgtgacgtgggcacacatagatacacacattcaaacagctaattaagaatttatcggggaacatttatccaaatacaagccaattctcttttactgatttaagaaaatgaagttttaatctttttagaaattcgtttaccaatttgataggatttaagcaattcaactatcaataagattacaaatattccaagtagagcatgtttttgggtcctagactacccggacttacacataatagaagctacgcatggactctcgtcacctcgtgcgtacatagctcccacaactagaagcacataaccaattatttcacctatggggataattccctcttacaaggttagaatggagactcaccacgctccaaagatccataactggcattcctcgcccttccaaagactcgaatcaatgcacaatgctccaaaactagccaataattatgcaaaaccattaatgtatgttcaattactcattataatccaatttataacaattcctaaccctgatcaaaaagttgacaaaatcgccctcaggcccacgtgtacggattccgaaattttttgaagataaagtttacccatgaactcacaaactcaaatatatgattttctcttaatttcataccaaaaatcgtggtcaaaatccaagaatatcaattttctaggttttccctcaaaccccaagtttctacgaattatcatgctcaaatccgcacataatcaatgtatttaactcaagataggtagggatagcttaccttgtcgttgatgatgaaaaccccctcttgaaacactccaaaaccgtccacaccaaatgaaaataggggaaaaatgaccaacccccgactttaaaagaatacactgcctccagcctttccgcacctgcggtgcataagccgcacctgcgaccatcgcttctgcggtgcacgtgccgcttctgcggtcccagggtcagggccaaaatctgcttttgtggtctcctcaacgcagttgcgctcccgcatctgcggttaaagtgccgcacctgcggtcattgcaccccttcgcacaaaccgcaaatgcaacccccttggtcgcttctgcggcttcgcacctgcacccaaaagctcccaggtgcggttcaccagatatcagctgcctcaattcttcctcaaattccaatattgatccgttaaccatccaaaatccaccccagtccccccgggacaccaaccaatcatgccaaccagtcccaaaacacattacggacttgctcgaggtctcaaatcatataaaacaacgcttaaaccatgaatcgccctccaaaccaagcttaaagaactttagaatttcaatcttcaacattggataccgaaacccatcaaatcacgtctgattgacctcaaattttgcacacaagtcacattttacattacgaacctattccaactttcggaatcgaattccgaccccgatattaaaaagtccacttccggtcaaacttctcaaaaaccttcaaatttctatctttagccaaatgactccaaaatgacccacggacctccgaattcactttcgatcgcgctcccaacaccagaatcaccatacggagctattcccaaactaggaatcccaaacggacatcgataatactgaaatacacttcaacccaaacttatgaaattcttcaaaaaatgctaacttctacaataggtgtcgaaacgttcccggatcttccaaaacccgatccggacatatgcccaagtccaaaattatcacacaaacctgatggaatcttcgtatcccgattctgaggtcatttactcaaaaatccaatattagtcaattctttcaacttaaagcttccgaaatgacaattctctttccaattcaaccctaaacttcccgaaattcagttccgaccacgcgtacaagtcataagaccagaagtgaagcaactcatggcctcaaactgttgaatgatgtgttagagctcaaaacgaccgatcgggtcattacatcccgatctatggtggggtctttgtgaccacggtgcagtcttcgtgaccgtagtgggatttatgcggtccgcaatgagcaaggccatgtcttcgcggctgcgctagatatttcacggtccgcggtggagctccgcggccgcggtcctttttatgcgttctgtggtgagggtctgagagaagtatatataaacgagacttttcagttatttttcaatttttaaaaccctaaaacataagaggcaatttttcaagacactctttcttctccaaaacacaagtaagtgatttttaacttatttatttcactccttaacttccttttacaagatttaatcctagaatctagggttttcgtggtggaattgggaattttgggtagaacttaggaatatcggaatttggggatttagacctcaaattgaggtcggattccaaaaccaattatatatccgagcttggggtgaatgggtaatcaggttttggaccgaatttcgggtttggaccaagcgggtccggggtcgatttttgactttttggggaaatctttataaaacctatttttatgcattagagttgattcatttagcatttattgatatcgttaagtaaattatggctagatacaagcgaattggtggtggaaataagaggtaaagcggtagttgaggcttgaatcgtgttcaaggcatcgaggtaagtgcttggtctaaccttagcttgagggattgggagttgtatcttatttgctatgtattaattgttgagtacgacatataggcatggtgacgagtatctatgtgttggtgtcaagcatgcttgtgagtcttatactattattaatgtgactctatttcatattattcatgccttatatgatgattactattgttgaacaaggcttgtggaactattattggtaattgaacattatagagcgttggctcaagttgagaattgagttgtgaagtaaatgtgggaaagataagagatttatgatattgtctcccttgctaggatgttattgcttttgatattatctcccttgtcaggatgttattactcatgatattatttcccttgccgggatatagttgatatgctattgttcccttgcgggattttattgttatattattgattccctagcccaaattactttgtaattgttgcttgggttaggaagagtgtaaagtatgaagggtgatgtcgtgtatgattttaagagtgttaatgcacgaagggtgatgtcgtgccaatattgtgaggtaaaagcacgaaggtgtcatgaccccggttctccctccatgaaccatcgtgacggcacctagtatctacgactaggtaagcctaacaatgctgaaaataaacaaaatttgcggaagaaataattaaaaccaaaatagtgaaataaaatagtgtttaaaatgccgctcgacatacacaatagcaactctcaaaactaatatcttttcccaaaactcgaaatctcatgatcacaagcttttaaatgtctacaagaatctaactccagaatatctaacaaagagacaaaagtacagaagggctaatacaaaaagggagagtagaaatggactcttcggtctgcagatatacctcggagtctctacaagcgccttgtctcaagcgtgataagtctgagtgaaagtacctagatctgcacatgaaaaacatgcgcagaaagggcatgagtacaccacagcggtacttagtaagtgccaagcctaacctcagtcgggtagtgacgaggaaggttagggccctactgatgttaaatgaaatataaggtatgacagtatagagtaagacagtaaatattaagtgcaacagtaagaaataatatagaatagaaagaacaataacaattataacagagacgaggaaattcatggaaagaagtacagctcaacaaggagacaacaaccggggatctctcagtatctcgaggatctcttagtatcctcaatatatgtgtcggggatctcttggtatccagaggatctcttagcatcctcaatatttatgttggggatctctcggtatcccaaggatctcttagtatcctcaatacgtgtcggggatctcttggtatcccgcactacagtctaaatcaatatatctatatgcagtgggatctctcgggataccgtcccgtagtcccaaagtaaacatgcagcaacaacaggaagaacactcaactaaattcaattttacaacaaggtaaataggtaattctagcctagcatgcttcacgtagtccaaataagacagtttgagcaaataaagcaattaagtcaattagccatgattctctaatctaacaacaggcttaaaagtgcaagtagaataaataggaagggaaaacacaattaaagttacttaatgaaaccaggatttttcaacaattagcacaagtacgcgctcgtcacctcatgtacatgacatttcaaatatcaacaataccaatcctaagaggaatgtcccccataaaaggttaagcaagcgacttacctcgaaccagctcaaaatcaacgtgaaaccacgctcttgtcacgagtactcaactccaaattgcccgaatctattcaattcaattgcataatgtaaataacacttcaagtaactgattttacaaataaattctaagctaatatgccaaattaggtaaaatgaccaaaacgccactcgggcccacatctcggaatcgggtaaaatttgtattctcataatccccatactctcacgagttcatgtataccaaaattatccaaatccaaggtcaaattcctaataaaaattcgaattctaggtctaagaactttcttccaattttttcccaatttcatctccaatccgaaattaaatgataaaactaacaatagattagtggaatacaactagaaagggttaagttactcaataatttcctcttcaaattcctcccaaaattgccttctcccgtgctccaattttatttttccaagttttgaactaaaccctcgattcggtcccttttctgaccagtgaaacggcacctataatcccgcttctgcgaagaccctgtcgcatctaagacatttcattaaagggggacttccgcacctgcgattgctctaccacagatgcggtgccgcttctgctgtacctgaccacatttgcggtcaattgccttttgcctcaaaccgcttctgcggttgctcgaccatttttgtggtctcatacctgtggtctccaagtcgcaactgcggttatgacagcagccttgaagcttcagctgtaactcacaactccaaacctttccgtcaaacatccgaaatcatcccgaggcccccgggacctcaaccaaaagacgaacaagtcctataccacgattaaaacttatgccaatccttaaaacacccaaaacaacatcgaaacatcaaattaaccatagattagagcctaagaactccaaaaactctcaaaatatgctttcgatcaaaaaatctatcaaacctcgtccgaatgacctgaaattttgcacacacgtcacattcaacactacgaagctacattaacttccggaattccattccgagcctcagatcaaaatctcactatcgaaccggaaatttcaaaaattcaactttcggcatttcaagcctaaattagctacggacctccaaaactcaacctgaacacgctcctaaacccgaagtcactcaacgaagctaacggaaccatcgaaactccattccgaggctgccttcacactattccgaccacggcccaaattccacaacctaaactctcatttacggactaagtgtcacaaaactctctgaaactccaaataattcctcctggcaactcacaatagtagaaacaaacacgggaaaaacagttaataggggatcggggcgttaattcttaaaacgaccggccgggtcgttatagaagggtgataccatgccgcacgatataaaatgtcgtgtcgtgatatgagtgataatgcacgaaggataattccttgccatgatcttcgtgccaaatatattgattcttatggtgaggacgagagtaaaagtatgaagaatgatgccgtgcacttgtcttttatttctaattcttgttgatagttgaactatggtgttctttacatttatctgttgttacttgttgttccccgcagcatgtttccccccttctatccataactgtaaatttgttgcctttatttcccgctgtatatgatttaactgcagaggtttatttggtagtcttgtcctagtctcgtcactacttcgccgaggttaggctcggcacttaccagcatatggggttggttgtactgatactacactctgcactgtgtgcatatcccagtgctgcagcttttgggccacattgaggttgctaccttcagtccatcaggtgatccgaggtagtcctgcaagcgtccgcaggccttggcgtctcattctatccttccatattatttcttttatatattttagaaacaactttgtatttatctttcaaaccattatttgtagtactcttagacagtctgtgaaattatgacaccaattctgggtagtttatgtttaaggatttgtgtcggtattattattaaattgttacatttcgttcttccacttatttaattccgctgtttatataatgttagttcacaactgttaaaggattacaaatagaaaaggtaaaatatccgaaatgattggcttgcctagctttcactagtaggtgccatcacgactcccgaaggtgggaaatccgggtcgtgatattcttaaattttttcataattttattttttaacgtattattttaaatgtggacttataattttttagtgctacaataagctttatagtcaatattaatgctaataaaagatattcaataaattatattaggaaagacaatagtattggatatctatttttttttagttttttcatgattagataaaatgcacaaattatttttttagtgtttagtcatgtaaaaataatacttattttagcattttagtgattttagattatatttattttcattatggcttactaataatatttagtttatgcgattttattatctttattgttgaatattttagtataatatcatgactcatcacatattttatattattttcttgaaaaatatcttatatagttatgtcttactaggatcaaagaaatatttgaagcacaaattctatgatttgtgctatgaagactttatggagagagaaaaaaatcgaaataacccaaaaactcgagaaaaatcaaaatttaaaaacctgacttttattgctttggtttggtctttagatttaataatccagcactattggtttggtttggtaattgaaaaattcaaaccaacccgacctatgtacacccctaccactagcaatgcaaggattgttacacaaatagtcggctagattcaatgtttattttttcaagtcggtatacataaattatactttgatcacacacacacacacacacacacacacacacacacacacacacacacacatatatatatatatatatatatatatatatatatatatatatatatatatatatatatatatatatatataatatatatatatatatatatatatatatatatatatataaattatatatatattatacattgggtgaccattttaagattaagagattagatgggcggctatacggtataattcttcaaaatttcaaaactgtttctcattttcactgacgggctaagcccctagttctgcttctaggctggctcaatcttttgggctaattaggatccattaggctagactagcccatgattcaattgacaggcttccacccgcttcatacttatcactttggggtattatcacttttagtctgcgccaaaaattatttacatctcgtaatcgaaaaaatatataatttttgtatataacatacaaaatgtgtatgtatatatacaaaactatttacagaatttgtgtgtgtgtgtatatatacaaaactatttacagaatttttgtgtgtgtgtgtatatatatatatatagagaaagtaactaaatttttttataaaatatatataaattcggtcaaaatccacaatttatttacaacttgaatatatttttttttgtacaaaaatgctatcaaaatttgtaatttacatataacttatacataacatgtatgcagttatgtttattgtatatattttgtatgccttctctacacccgacatacaaaatatatattatttgtttatgtcttcttcttcttcgagttttaatttgaaattcctaatcaaaaccatctcgaatcttcaccatattccctcaaaatttagatataaactccaaaggatattctcaataatttgcaacaacgtccaatccaaacaaataacaatcttcaaaaattcaattttcgaattcaaagcttcgaaactttttaatggttgtcaatgaattttaagtctatgtcttcacggtccaatttagtttttgattttaaatttctgtttagtgtcaattatagagttaattataggaatttttacattccaatacactatatgaaactatattactcatcctactcaagttttactataattacattttatatacccaattaccatttatgtacattttaagggaattaatgataataattagtgtcctaaattactctaacatatcttccactccccatgtttctctctccacatcccaccccctcccccacgtatcttgcacccacccacgattccaccattgacaaccattaaaaagctttgaagctttaaattcgaatttgggttttcaaaaaacattgtttgttggaattggatgttgttgaaatgaattaggaattctctctacgtctctctctatctctcaattcctaatttcagtaatgtaaagcaaaggaaaagagaacagcaatttcaccattgacagtcattaaaaagctttgaagctttcaattcaaatttggattttcaaaaatcattatttgtttggattgggtgttgtttcaaacaattgggaatatggtttggaatttatatctcaattttgaggggttttggtgaagattagacttggttttgcctaaattttagattaaactcgaagaagaaaaagaagaagaagacatgatataaattatatttgcgaaaatgtagaaaaattgtattatgttgtttaaatatttttaatgttttaagcttcaataccacacaagagggggggtgatttgtgtggtacccaattttcgctatagaagaacctggttcttctaggtgttttaactactactgtttgcggaataataagtgcataaaataaagaacacagagatttttacgtggaaaacacctggctcaaaaggtgaaaaaaatcccgacctactactaagtaggattttcccaaacttccactaaaatcactgtgccaaaacagcatttacaaaaactctttgtaaacataaggattaactctaatcctgttgtggcacacagcctcaactgttacgacaacttcaagttagctataacttgaacactctaggtacctaatacaattgcttctatgaaagctgaaaggtacaacattaagctacctactacaattgaactagagtaaaagatagacacaatggaactggttcttctatctcgttcaagtagctttaggagtgcacactcaaatcacacctaaattacttgcaaaatcacattgctttttgctctcaatttagtttcacttctgcgtatgtgcaatacttataaaagagaataatcattgtcatttaataggttagtaatcagagtttgatcgggactcaattgctgaacttctatcgtagaagagttcatgatgatctcaaacactaacactatctttatcctggatcatgttctcttcatataaggagactttctccccttatctaatatgcaaccttttttatcagatcaggagattgttgcttgatcagcaggacttatctccttcacgtgcatctcacattcatagattgatcatgattgtgcttcacaagatggacctggtccatgactgagttcatttgtcattctttaaaacttcacctgttcttgggccaataaattttccctttttgatgatgacaaactttgtgctttttactgatttgaatcatgtaagaactcaggttaaccatcaatactaaacttagaaaattcacttatcatcaaggaccaggttaattaggttataacaatcacttattttcagaatgtgtaaagtacaatatttcttcccccttttggcatcatcgaaaagttgcatacgaagtgtgatacccagattttaataagtactcatggccactagggcaactgcaagtgcaatcatcagtaatcaaacaaacatatttaaactatcaaggacagattaatcattgaacaagagaaaataacagttatcattgaagagatatgttgccacctacaatccacaaaaagaaagaaaaacattaaaaccatgagcaaaaaatagaaaaatccctaatctgggtcactggggtactgaacaagttcaggagacagaagctaggaatcataaggcttggagaaactggagggttgggtttgagtttggagaagattcagcatattttgaagaattccatcattcttctccttttctttggaaagctcagttctgataccatccctcttagtttccacttcaaccacacgagccttgagcctaacaatttcagcatccttggctgcacattcctgaaccatagtcctaactttgctgttgatgggtgtcttctgggatgaaccaggttcaatggggatggcattaactcaatagtcacaggcaagaagagtttgatgccaaagtgttccttgctcgaagccatttcccatttctttagaggaacatttaacctgtacagaactgtaatcagaatgaagccatatggagtagcatgagctttggagctatttatgaccctgtctagcagtttgataatgaaggcatgccagtagatttgctttcctctctccaggaactccataagaactagatccatatagttatcagtgtgccttctctcctgtctggacaataagcacttattgacaaattcaaacacaaccttgtgctcagacctcatttcactcttctgcacagccctggcttcagtcacatcttttgaatcacaaaacctcttggtgatttcaagggtagtagggagggagtccaggcatggccacctttgctttgtatagtcatcaaacccttcagagggtatgtccggatctctcccagtttctctgcatcaatgtgcacttgaactcctttcaccaggctactaacgactccatccttaacagtagcattggccataaattcaatcagcttatttctggctagcctaccatccatctaaaggaccatttccttccatccctaagcagctaaagcatccaccattctcatcattcctggttccactaggtccttcaacagtctaccctttaaaatatttcttctgccaaaattggcaagcttgtcctgttccttctcagaatcattttcttcttattctccactccagtcatcatcatcagaaacttttgattgtttggttttcactacagatcttgtgctcttggctagtgtgggttcaacagctacaggcacagaggaagacttcttggaagaggtcttgggctttttaggcatgggtgtaggaacctctactattgtacccctatcttgatggaccagttacatatcctcttcctcaacagcctctgaggaatctgcaatttttccctttcctttatcctttatctttttcttattttattctaaggccctttgtaaattagcttcagtctgtttcacactgcttcttgtggatctaccccttggcaatgaggagacagtaggtgttggagatgaagactttcttttcttggaagtctttggaatatttggggcttttgttgtgggagttctgtatttctttgggtcatagcatgctccaacctttttcagtagatcagttatggtctcttcagtatatgaaacaggttcatctctctgtgtgctcagatgaaccaacccttagcatcttccccagaaccacttccccttgacttcatgccactctcttctactctttcatgttcaaccccacagatggcaggcactataattttctcaattcccatatcttcaccacaagcaccctctctatctttttctttttcaaaattctttttacctccactcctatgtttctcaggaacttcaacatctctaattggtccaaccagaacaaacctaatctctaggttttcaatcatagatgaacttacctcagaaggagattcttgaatcttttcaaagtcagaagacccatgtccttccccctcagctgcggattgataggattcagactcagagctggagtcggaatttggagcttgtctttctttaacttggcttgctttcaacctttcatttaaagccttcctcagagccccagatgatacaaccattcgagcaagcattttcacccttcgtagtctaggttttggggatacactgggtcgagtagatgaggatgaatttaagggagttccaagattttcttctgggttagacatgattgtttgtttcttgagagaatctgggaattttggagaagaggacaagtgaaagtgaaggaaagtttttgacggtttggagttatgatgaaggctgtaaaaaagatgtgtatttaaaggaattacccatttaataagaagcggcagccttttgcagtggtcaaataggagtctaatcaacctaaaattccagattttgaatgatctatttggcttccctagatattaggcaaaaattacggtttagagttctaggtggacggaactggttcaatgctaacgaatagaattttctaggaattttataagtataggacttctgcgcatgattgaattattaatctttctaattgtgccgagtatagaaaacatacctgagctttcatatgaactcatactgatgaaccaggttcttcatttagaactctcttgaacatgactcaaatgccataatatagaaaatttcgtaagagatcagtgagtcatataaacacatggcacaggagtatactaattaaagtatgaagctgagtaagaattaatctagatatttacacgagttcagaattcctagccaaaattttttttttatatattttttttcattgtgcattctcagttggacctattaggtgatcttaatcatccctaattccaacattttcctctcaaagttttctgtactcagtgttgtagtgaagatgtcagcaatttgcttatcagtagcacagaattctatagagatcaatcctttctcatagttatctcttaagaaatggtgtctaacatctatgtgcttagtcctcttatgatgaacagggttctttgtcatacttatagcactagtgttatcacataatataggaatgcaaccaacttcaatgccaaaatctaccagctggtttgatccataacaattgagcacaacaagatgcaacaatatattcagcctcagcagtggataaggcgactgaattttgctttttagtggcctaggatacaagacatgaaccaagaaaatgagccatacctgaggtgtttttcctatccacaaggaaacctccataatcagcatcagcatatcctactagattgaaattactacctttgtgatacaaaaaacacagatcagtggtgactttcaaatatcttagcatcctcttgacaacagtcaagtgagactcttttggattggcctggaagcgagcattaagccctacactgaagactatgttaggtctactagcagttagatataagagtgaaccaatcattaccctatacaacttttgatcaactgatgaaccgggttcatcaatgtctaattttgtggcagttgcaatgggggtgtctatttcttttgattcctccattttaaactttttgataagctcttttgtatacttctgttgatggatcatggttctatttaggctttgtttgatctgtaagcctaagaagaagttaagctcacccttcatactcatttcaaactcactccccattaattttgcaaaatccttacttagcttatcagtggtggccccaaatattatgtcatcaatatatatttgtaccacaaggagatctttacctttttcccttaagaataaggtactgccaattttacctcttttgtacccatgttcaagcagaaatttggacagtcgttcattccatgctcttggagcctgcttgagtccatagaaatccttgtctaatttgtacacatgatcaggacattccttgctctcaaaacctggaggttgttttacaaacatttctgctttcaggtagccattcaggaaggcacttttgacatccatctgatgaagagtaaatttcatgtgtgctacaaaggctataaggagtcttattacctctagtcttgcaactggagcaaaagtctcatcataatctatgccatcctcttgactgtaaccttggaccaccagtcttgccttgtttcttgtaactgttccatcttcatcaagtttgttcctgaagaccaattttgtaccaataactggtctgtccttgggtcttggaactagatgccaaacttgacttctctcgaactgattgagtttatcttgcattgcattcacccaatctgcatcctgcaaagcctcaacaacatttttaggttcaataagagataaaaaggcatcaaaagcacacagattctttaattgtgatctagttttgactccagattggatcggtgataatgttctcaataggatgagaactttgatacttgtgatgtttcacaactaactgtttctgctagatgtttctcctatattctattgctaaggaacatggtcatgaacaggttcttttaggggtttttttcaattcctctttgatcagtttcccttgtcaggtttccctgagtggaagaacctgttccattatatgttccttcttttggtgccactttatcttgtgctgaggcttcagtcaaatcctttaccaatccaatagcttcatcttcatattcctgtctctcagaaagaatgttagtttcatcaaacactacatgaacactttcttctacacacaaagttcttttattgaacactttatatgctttgctatgtgaagaatatcccaggaatactccctcgtcacttctgggatcaaacttacctagggagtcttttccattattgtgcacaaagcacttgcatccaaattccctaagatgggatatatttggttttctccctttaagtaactcatagggagtcttctctacaagaggtctagtcatgcatctattgataatgtaacatgcagtgtttacaacctctacccagaagttgtggggtagtttactagaaagaagcataatcctagccatgtcttcaagagtcctgttctttctttcaactactccattttgttgagaagacttaagggcagagaagttatgatctataccattttcatcacagaattcaacaaacttagcattttcaaattcagttccatgatcaaacctaatggatgcaagttgatttcctaattatttctgagtttttctaacaaaagcagtaaacatgtcaaatgcttcatttttagatgttagaaatattacccaggtatccatctagaataatcatcaacaagtaccattacatatttctttccacctctgctcaaggttctcattggaccacagagatccatatggaccagttccaatgacttggttgtgcttaacattttcttgcttttgaaggatgatcttacctacttcccccttgcacaggcctcacaaactttgtcttccttgaacttgatgttaggtaaccttatcaccaagtccttagagactaatttgtttagctaattcagactagcatgaccaagtcttttgtgctacaggaggggatcattatccaacacacttagacaggtgagtttagaaagagtagacaaatctacaatgtaaatattgttaactctttttccctgcaaaacaatcttatcagtgataaggttaatcacaaagcatttagtagaggtaaatgctacaaggttacctctgtcacacagttgtgacacactgattaagctgtatttcaagtcatatatcaagtagacattctcaatggagtgagaatctgtcttacatacctttccaaccccaataatctcacctttattcccattccaaaggagacattacctccttttaggtcctcaagttaaagaaactggttcttgcttctagtcatatattttgagcagccactatccatgtaccatatttggctacttcccttcacttggacctgcaaaacgaaatcaagggttagtcttaggaacccaaactagtttgggtctctttctataggcaaagggataaatcaaattccttttagcccacccaggcagcctatttatatcttgaacaaaagttttgttcttttgactggccttttcttttgcattatattcatttttgtaatggccagtcttaccacattgtgtgaatattttgttctcaggaagagtgagatacttgattttaggatcccacttaggtgcttgaattccatagccaagtcctcttttattgccactgtgatgttcttgtagccagaaaagtacatcagaagccttgttccatttgcaagttctgtctagttcatgttttaccttctctagatctttttttaagacttttatctgctcatccctcctgtacaactcatctttaatttttcccaaagttttcttctagagtgagatgtgtgtggtcagctttcttcttacctgtccctagtttcagttttaagttctcagacctaagttctaggatactggcgtcaagttcaagaacctggttcttcaactcagcatttttactctcactctcattagccctagactctaggtttttgcacttggcttttagtagcacacattccctagacagatcctccttctcattgttaattatttcagactcatcaatgaaatctagcaataactcagacaacctttctttagataggaatgtaatcttatctttgagattaaggatacttacctcttattcattatctgattctccgatggccataaatgcttattcatctccagcttcatcttctgagtcctcatctgatgtttctccccaggcagcaaccatagcctttgttgatcatttgttcctttttggttgaacctgttccttcttcttgtcccttcgtttagccctttccttcttctactcaatttcccattgagggcaattcttgatcatgtgatcagtcttaccacacttgtagcaaccctcattggtatgtttctcaggagcccttagtttgttaaaggttgtacctcttgaagaaccctttcctctcatcaggtactttttgaaatctcttgtgatcatatccatttcatcattctccagatctgaaccttcagcaattctaagagccagacttctttccttcttaggtgcatccattttcatggtttgccttctcagttcataggcagtgaggtttccaattagttcatctagcttgagggtagcaatattctttgattcctgaatagcagtgattttgctttcccaagagactgacagaacccttgtcaaaatcttctcaactttttcttcttcaagaataacccttccaagagacttaagttcatttgccagtgtggtgaaccttgtatacatatcttggatggtttttccttccttcatggtgaaattctcatactgagaatacagcagagttcctctggacctcttcacttgaggtgtaccttcatgggccacttgaaaagtgtcccagatttccttagcagtggtacagctttgaattcaactatactcatgtggacccagtccacacacaagccatttcttggacttggcattcttctcccatttcttcaaatctttagcagtgcagtcagctcttgtctttggcacatccactccttcagcattcttctttgtggttgctagaggacaattagtgactatatcccagagttcatagtcttctcctctgatgtgatccctcatcctgttcttccaccaagaatagtactgaccattaaaaggtagaggcctagcagtggattgcccttcctagttcccaggtggtgcactcattttgatattttcctaaggtgttagcctcttcaaggataacctgctctgataccaattgatgttttaggcgtcaataccacacaagagcgggagtgatttgtgtggtacccaattttctctatagaagaacatggttcttctagatgttctaactactactgtttgcggagtaataagtatataaaataaagaacacagcgatttttacgtgaaaaatacctggctcaaaaggtgaaaaaaaccacgacctactactcagtaggatttttccaaacttccactaaaatcactaagtcaaaacaacatttacaaaaactctttgtaaacctaaggattaactctaatcccgttgtggcacacagcctcaactgttgcgacaacttcaagttagctataacttgaacactctaggtacctaatataattgcttctacgaaaactgaaaggtacaactttaaactacctactacaattgaactagagtaaaagatagacacaatggaactggttcttctatctcgttcaagtagcttcaggagtgcacactcaaatcacacttaatttcttgcaaaatcgccttgctttttgctctcaatttagtttcacttctgcgtatgtgcaatatctgtaaaagagaaaaatcactgtcatttaataggttagtaatcagagtttgatcgggactcaattgctgaacttctatcatagaagagttcatgatgatctcaaactctaacactatctttatcctggatcgtgttctcttcatataaagagactttctccccttatctaatatgcaaccttttcgatcagatcaggagatattgctgcttgatcagtagaacttatctccttcacgtgcatctcatatatatagattgatcatgactgtgcttcataagatggacctggtccatgactgagttcatttgtcattcttcaaaacttcacctgttcttgggccaataatttttcttttatttatttcactattgtatgaaagttgaacaacattgtataaaaattatatttaagttgtatgatattgtagttgtatataactgagtagaaataatatatgaaaattgtagataagttgtataatatataattagttgtatgaatttttttttactatgtataaatcagatacaaaatatacaaaagacatattgtataaattttgaataaaatttctatttaagttgtatgttattgtagttgtatttaactagatagtgcacgaaaaagttcacatgaataaattgtgtgcatataaatgaattcataatatgttaacaaactgacaactgaatattccattactacccattgacattgtgacaactaaatttcgctcctgaaaaataataatcaagacaagaaatatagcgataaatattatattcaatttcaagtgatggggttacaatctctaaaatatctctgaatctaaatagatgtagtcctctaattcttctcctcacggatgatggttcaagagcttgaaagcttgattttgaacttgacgaatttcagatttgtagtacgtcacaaacaatttgaagcttgtcacgaaccaggatttgatgttgggttatcacgaacggaagatttgaagccgcccgcctatgacttgagttcgcctttggaatttgaccacagacgacgattgcagatatggatgaagaccttgatgctattcttcagagcttctttagtctttccttctgcttacttgcttcttctttagccttctcttttgactcctttatataggtgtggggtggagtagtctccaagaaaaccctagtaaattattaggcttgaggcttatgggccgacccatttgatagaagaccaattgacaggctagcccaataatatattggacctttatttaaatcaatttggttggatttaaataacaaacccaattataccagtccatgttacttaattggaccaatatatatttaatttgtggtaaaatccaaatttcttatggatttaaatttgacacaattttaattgtctacaaatgcccctacttcaaggcttggtgggatgtaagcttgcgaaaatgaatggcgagacttaaagtaccgttgatgatgacaatacttcccccatcattttgtaagacaccacactgataattatttacatgttctatttccgaagagtgaattgacgttatcaatgattggaattggccactcttttacttcattcaaagtgagccaaaatgacccctaatagcaagctgggctcttgtagcttaattccccttcttcaatgagaaaataaatttggtggcctttcttatgtagtatcaacttgattaaagaataactaagttcatattgaactaagtcaaacacatccacccaggacaaattaaaatttaaaccgcgggatttacgagaaacatttggtttattcacttgcatcccagttcaaaggatatgctttccttggaacatttactcaaagaaaactctcacaacatagcgctcctccaatttggctgctacgataatatatttcccttacttgttatttcctcgtatgaattggagagacttcacattggccagcattagtagtaccacagaatgatctttattacctagatggtgatcaattagcagattttatggccctttttttttactaagaggtgaagcaggcaacataggccttgacaagagcataagaggcaaggcaacatcctgatcaacaactctttgcctaagcttcttggctatatcttccccaagttgcaagtccttttctctaattcacattatttggctatgaatatacacactcacattcttttcactcaactttttcgaaggagatgagctcactctttcttgatgcgtctccatctcacgattttcaaatgagtatataattgtggcaattatggattcaactatatattcacgacagaataaggatgaagttttgaggcaagtaaagtgatgataaagaaaacaaaagtatgccgctatatagttgtcatgttagattggaaagtatgccgctatgtagttgtccgatggcatcaaacatggaaaattttaaagcttttttttaactttcccgtaacaatacttgggctgacaataattttccttttctactttgatttcctagtttcaaacctattcatgtacaaatcggacatgatatttccttatttgcatatgtcagtagcttgaacaccaagaatttccttaatttctttcttgttggttcttataaattcgccactttctccttgtattgttgttatagcagcagtcctccacttttgatgaaagcagtagtactcttcaatagttggtattacgcaatcctcgtcgctcaattctcctggagcagactaatgttttttttctttttgctgcagctgctgccaggaattatcagcattgcgcgtcttaaccaaaacaaattatatctcggtgtaggagcatcgaaatcatgagcgatttgcggctaccaaaactagactcggagtactacaacatatcaaaatttggatttaaattcgtattgtatcatcccaggtgagcttcataatcttggttcaagttctgtcacgctcgacatttcagttttgcgcgtcataatcaaaaaaatcatatcttggtgtaggaatgccggaatcacgagcggtttgtggaaacagaaactagacttccggagctacgacataggtaaaaatcattatcagaatatgcagatgtattcccagatgttttctcaaatttaggcaacgtattatgacatgctgccccattctgtcttgctgtttttatttttcatagattcttccccttttttttcgcagactctcggagcagcacatagggctgtgaattccatcaacaaggatgcgtttcatcgaccatgatacaccatacccacaccttgagattattagcgacaagcagagtccgcgcgcccaagttctaactttaaaagttcatcctccggtgataggtgctttcccgctcgctagaaagccgcttgacgcctcccttgatcttgcagaatggtcgactagagagacgaaggatgcattggacagattttcgggcaaagcaaccaacatgaaggtcctacttttgaagtcctccacccatcaaaaggccgcgtctactagtcctcttcatcgtgattatgatggacgtcttgccacttggagtgttcctccttccggatttggtgaagtttgctatacatccaaataatgggagtgggtagaagatgttcttgcccgcaacaagttgactttgtatggaatcaaggtctatgacgccatctttgcttcgttgttcacatatgactacaatgagaatgtcctccgtgccttttgtgagctttggcgttcatctaccaacacaatttctacctccattggtgaactctccatctctttatgggacttgcgagaaatcggaggccttccggtgcatgggtctttctacgacgaagttatcccctcggctaaggagttgacacaagaagacgatcaaggaaaacctttcctcccaagaagttgtctgcacctgttctcggcattctacaaactcatgaaggatcatgtccacaaggtctccattcgtgattgggtggagttttgttttcgaggaccgagtaggtatgccaagcctccgcaaaagtcatcaaggaatcggactacaaggccgaagttgaatcataatccttctgggaatattgacgcgagcttcctaccacgaaccgatgaggagaatgacccctttattgagcttggcgtggaggagtcacttagagctgagacttatttggcggctttccttgcatgttggctttgcaaatttgtgttccccaacaagaagatcgactacatttgtgctagtgtcttcaaaatcgcgagtctgatggctcatgtagagaagttttccttggcggttcccgtccttgcaagtatttatcacggcttgaatgaggtctccacttctcaagatttgggtgcctgcaaagcactctttcctattcattacgtatatggatggataggagcatattttgacacctactatcgtgttaagcgtccacaacgaggtccgcaaatgtgcaaggtttctggcgagaagatggacaagcattttgaccttagtaatgcccgtgagttgtttcaacaagttagtgcgcgacagcttcaccatttggctatgctacaagggagggaattgcatcttaccgatcgtgacgaacaatcgaattcttggagtgacttttttataagtctccgctcaagcttcatcacccttaggcatgacgacattcatattgtggaatcttatagcctgcataggtttagtcgtcaattcggcttttgtcaagatgttcctggcaacctcatagagcgaccctataacggctcactgagaatgctagtgcaattctgggactcctgtgttcgtcttggaggttcatcaaaggttattgtccctacgtgtccatcagaggagggacctctaatgactcgtgagtatgcagattggtggtaagctcatcgagtgcactcttcccgacaaagtactcatatcattttgaaagttccaaggaaagatgatattcctttatcctccaaagatgatcaacgtcaaaagaacactcacgaagggtcttccaagtccaagttaagatcgaaagatccttcgccaagcaccaagaccttcccatagaggctttcttcaagacgtacgcagattacgatgctttaagatcgtccaagatgactaaagaatttcaccaagagtcactttctgatgcacgacgacgcctcgatgatgcaaaacaggaatatgaaaaagtgagcgagtccgtagaaaaacttcaagccagtcttgcgaatgttgaataacagctagcttccttggcctctagaaagaagaagatcgtcgcactcttggacaaacaacaggtgaagttggctaaaagtcaagagaacgttgacgttaccgaaggggagatttataccattgaagccaatcatccattatctgacgatgaagcagagaaattatccctcctgaaaggggcagttgagacaagccgccaacaaatccttagcttcaaaccttttccatgattttagagttttttttttctcttttttttttttgcttaggattctcgacttgcgaattttttttacaactaatatcatgtaatggagtacttatatcttggtgcaataaaagtatctttattttttttaatatgtgatatttctctttgagacctggattccctctgttactaccaattatttccttcttaaattttagcatatgtcttgtatgttggttttgttgtttcgcgaaaaagaattcatattttgctgtaggagacttcaaaacataagccacttgcttcaactgaaactagactcataggactgaaacgtatcaaaaaattagcacgaatctccttttgtatcagctggaattaattttcaaagtcgatctacacgtctggcccgtgtttagctcacatctttgcgcactctgcacaaaataaatcacatctcgagattggagcattcaaatcacaagccgtttgagatgtcataaaatagaccggagatctaaaacttgtataaatttcataacagaactcttttcggactgtgaacagaaaattcacgaagtcgactcaactgcagtgaattttcagatttgcgtaccttcggcgaaaataattgtatcttgagcttggagtgtcagaattgcaatccgtctgtaccgttagaaagaaggcctggagatctaaaaactcatataaattttataacagaattctttttggactgtgaacagaaaatccacgaagtcgactcaactgcagtaaattttcagatttgcgtaccttcggcaaaaataattgtatcttgagcttcgagtgtcgaaattgcaatacatctgtaccattagaaagaaggaccggagatctaaaactcatataaatttcataacagaactcttttcggactgtgaacagaaaattcacgaagttgacacgactgcagtgaacttccagattcacatgaatcatgtattccacacattgttttcttgaagcttaagcgactgaacttagaataaaactctatgttgccaacgtacctcggtgaagaggatcaagtcctaacgtagttaaaaataggtgagtttttttttgtatcctaacttttgcctaggccgcctctttcgaggtttttgacctagcggactcctttttttgggtgtcgttcacaatttaggctcatgcgggccaggagaattgcaacatgcagtttagattcttgtgtcaaggagcgtagcagcatgcagtttaggctcgtgcattaaggagcttcatgacttgcagtttaggcgtgtgagtcgaggagcgtagcagcatgcagtttaggctcatgcattaaggaaattcatgacttgcagtttaggctcgtgtgtcgaggagcgtttattcttcaaggatagtacctattcaaaaatttcccattgatagggtcagttctcatgtcatttgcatcaactaacttgtaagctccacttgaataggcttcttgtacaacatatggaccatcccactttgaagtgaatttgcccccagatttgcgagaggtgataataggtcttcttactgcaagaacttgatcgccaacttggaaggacctcaagcgaacctttttgttgaaagcacgagaaagacgagcttgataacattcaagactttgttgagcttctagccttttttcatcaagggattcaagttcttcaaggcgtaggcgagcgttttcttcctcaataagaccttcttggacagcgagtcgcaaggatggtatttgacgcttaagagggaagaactgcttcaactccataaacaagagaataaggagttgcttgtatcggcgtgcaatgtgtcgtacgatatgcccacaaagcttcttccattctgtcatgccaatatcttttagacttggagacaaccttctttaacaagttgcaaagcgtcttgttaaatgcttcggctagtccatttgcagcagcataatacattgacgaattacgtttcttgaagccaaaaagttcacagatcttggtcatcaatttgttatcgaacggtttgccattatctattattatataactaggaatgccaaaacgatatatgatgttcactcgaatgaagtttgcaacattctctttcttcacttccttgagagcgacggcctctgcccattttgagaaataatcagttgcagccaagatgtatagatgtcctccagaagattttggaagtggtccaacaatatctaatccccaagcatcaaatggccaagatgcaacggtagggtgtaacatttcaggaggttggcgtataaaatttgcgtgaaactggcaagccttgcatctccgagcataatctaagcaatctttcaccattgtcggccagtagtaacccatcctcttaatgtggaagtggagcttcagcccggattgatgtgatccacaaactccagagtgtgcctcttgcatagcttgagttgcttcatcttcccctaaacaacgcaagagaactccctcaaatgatcttcgatacaaagtgtctttgtagtaaaggaagcgaggggcacaccaacgaatttcggtctttcttcttggatcttctagaagtatcccataacataagtagtcgatcatggtttgtcgccaatcaaccttcacagcttcagcgacggctaccaaatgctcgagcttgctttcttcatcctcgttctcatctggcggtactatccatttttggtagatagtgatttgtgtctggctagagtaggtagggcgtcagccttcttattttcctttcttggcacatgctgaagagttacattgccaagccatccaatcaatttctgcgcataatcataataacgacgcaattctggctttttgacctcgtagctacctagcaattgattgatcactaactcagagtctccaaaaatatgtaattggagttgtctcatatcaacggccatctcaagcccaagtataagtgcttgatattccgcaacgttgttggtgcaatgttgtgttaaggtgaaggaatatggcataacttccccttgagaagtgacaaacacaacacctccaccagctccctcacgatgtgtggcaccatcaaaatacattttccacggtggttgcacttcgatgaccatcgtatcctcatcaagtagttcatcagtcaacttccaatcatcgggaattggatgatctgccaagaaatctgccaaagcttgtcctttcacagctttttgtgggatatacacaatctcgaattgttgaaattggagataccaccttgctaatcgatcattgaggacgggttttgacataacaaacttgatcgggttcgcccttaagacaagacggatgacatgagcttgaaagtggtgcttcagcttttgaatagcgaaaaccaacgccaaacacaacttttcgatcatagaatactttagcttatttggtcatcatcctactcaggtagtattgggaattttctttattttcaccattttcctgggtcaaaagggctcccactgacctttcttgggctgcaatatatagaatcaatggctttcctggtataggggcttccagaactggaggtttcatcaagtaggatttgattctttggaatgcattgctataagcttggtcccattcaaaaggtatacccttcttcatgagccggctaaaaggttggcacttccctactaggtttgagatgaatcttctaaggtacgccaattttccttgtagacttttcagttcatgtatatttttgggtacgaacttgctccatttattgacttcttgcttatctcttcccttgagaggtttgtagaaaaacttcaagccagtcttgcgaatgttgaaaattcactacagttgagtcgacttcgtgaattttctgttcacagtccgaaaagagttctgttatgaaatttatacaagttttagatctccgagtctattttctgacatcgcaaacggcttgtgatttggatgatcctatctcgagatgtgatttattttgtgcagagtgcgcaaagctgtgagctaaacacgggccagacgtgtagatcgactttgaaaattaatttcagctgatacaaaaggagatttgtgctaattttttgataagtttcagtcctataggtctagtttcggtagaagcaagcggcttatgatttgaagtctcctacagcaaaatatgaattctttttcgcgaaacaacaaaaccaacatacaagacatatgctgaaatttaagaaggaaataattgggagtaacagagggaatctaggtctcaaagagaaatatcacatattaaaaaaaataaagatacttttatttctccaagacataagtactccattacatgatattagttgtaaaaaaaatcgcaagtcgagaatcctaagcaaaaaaaaaagaaaaaaaaaactctaaaatgatggaaaaggtttgaagctaaggatttgttggcggcttgtctcaactacccctttcaggagggataatttatctgcttcatcgtcagataatagttgattgtcttcaatggtataaatatccccttcggtaacgtcaaggttctcttgacttttagccaacttcacatattgtttgtccaagagtgcgacgatcttcttctttctggaggccaaggaagctagctgttgttcaacattcgcaagactggcttgaagtttttctacggactcgctcactttttcatactcctgttttgcatcatcgaggcgtcgtcgtgcatcagaaagtggctcttagtgaaattctttagtcatcttagacgatcttaaagcattttctttcttaaaggtagaagtatcaataacattttctttcttaatttcctcaagactcaaagcaatactttcctccaactttgtgaagctatccagagaatcaagagagaactcttcgatccattcacacaaggtatgccatattgtgttaacaaaagaaagtttaatacgtgaaataatctcttgtggcttaaagtttggagcatcaagatgcaacggccatggagtaggctcgaaggtttttagacgttttgcttgacttgcggcaacctccatcttactcgtcatggctggcttggaaagcacaacatcttctggaagaacgaggtgcagttctttgggtagactcaaatctgtcgacggagcattgtttgcagcatgatgttcaacaccatcaaataaagtgtgaggactttttgtggccacaccgaggggatttgggcttgtaacacagtcttccaccgtgtcttcaccaagtacatcatcatacaactcattgacgcccaactgcaaaaaaaatagcaactttagtgttcaaaaaaaagggagtaaatttgaacgaaataatatttactcgtttctccagttcagacaacggcatcgttgagctagggtcaccgtctacgaaaaatccagtatcgatactaagggcatccaagtcagcaaattcactatggctcgtgttcttagccttcttctttgaacgattccaatgtatgtcttgactaacatcactctcgttcgaactggaagtggaactaacattcaaaatctcattgggcaaagcagaagcttaagtcctttcctcgtttgttggcacgacattggttgtcttcgcaacatttgtgtttggtgaagtagcaggcgctttccttttgcaaggattgttcgtcacctctacagtggcagtagttgtcttggaagtcaacaaaacatgtttagctcctttgtccacatggtttccccgccccatcgaaggggtagacttgggtaagaccttggtgcttggcgaaggatctttcgaccttaacttgggcttggaagacctttcgtgagtgttcttttgacgttgatcatctttggaggataaaggaatatcatctttccttggaactttcaaaatgatatgagtactttgtcgggaagagttcactcgacgagctgaccaccaatctacatactcacgagtcattagaggtccctcctctaatggacgcgtagggacaataacctttgatgaacctccaagacgaacacaggagtcccagaattgcactagcattctcagtgagccgttatagggtcgctctatgaggttgccaggaacatcttgacaaaagccgaattgacgactaaacctatgcgggctataagattccacaatataaatgtcgtcatgcctaagggtgatgaagcttgagcgaagacttataaaaaagtcactccaagaattcgattgttcgtcacgatcggtaagatgcaattccctcccttttagcatagccaaatggtgaagctgtcacgcactaacttgttgaaataactcacgggcattactaaggtcaaaatgcttggccatcttcttgccagaaaccttgcacattttcggacctcgttgtggacgcttaacacaatagtaggtgtcaaaatatgctcctatccatccatatacgtaatgaataggaaagagtgctttgcaggcacccaaatcttgagaagtggagaccttcttcaagccatgataaatacttgcaaggacgggaaccgccaaagaaaacttctctccatgagccatcagactcgcgattttgaagacactagcacgaatgtagtcgatcttcttgttggggaacacaaatttgcaaagccaacatgcaaggaaagccgccaaataagtctcaactctaagtgactcctccacgccaagctcaataagggggcattctcctcatcggttcgtggtaggaagctcacgtcaatattcccagaaggattatgattcaacttcggccttgtagtccgattccttgatgatttttgcggaggcttggcatacctactcgggcctcgaaaccaaaactccacccaatcacgaatggagacctcgtgtacatcatccttcatgagtttgtagaatgctgagaacaggtgcagacaacttcttgggaggaaaggttttccttgatcgtcttcttgtgtcaactccttagccgaggggataacttcatcgtagaaagacccatgcaccggaaggcctccaattgctcgcaagtcccataaagagatggagagttcaccaatggaggtagaaattgtgttggtagatggacgccaaagctcacaaaaggcacggaggacattctcattgtagtcatatgtgaacaacgaagcaaagatggcgtcatagaccttgatgccatctagagtcaacttgttgcaggcaagaacatcttctacccactcccaatatttggacgtatagcgaacttcaccaaaggcggaaggaggaacactccaagtggcgagacgtccatcgtaatcacaataaggaggactagcagacgcggccttttgatgggtggaggacttcaaaagtaggaccttcatgttggttgcttttcccgaaaatctatccaatgcatccttcgtctctctagtcgaccattctgcaagatcaagggaggcgtcaagcggctttctagcgagcgggaaagcacatatcactggaggatgaacttttaaagttagaacttgggcgcgcggactctgcttgttgctaataatctcaaggtgtgggtatggtgcatcatggtcgatgaaacgcatccttgctgatagaattcacagccctatgtgctactccgagagtctgcaaaaaaaagggggggaagaatctatggaaaaaaaaatagcaagacagaatggggcagcatgtcataatactttgcctaaattcgagaaaacatctgggaatatatcagcatattctgattatgatttttacctatgccgtagctctggaagtctagtttcttttgccgtaaaccgctcgtaattccaacgttcctacaccaagatatgattttttcgaaagaggcggcctaggcaaagttaggacagaaaaaaaaactcacctattttgaactacgttatgacttgatcctcttcaccgaggtacgtagatgggcagcccttcgtttcccgcagaagccatgctcaactccatatcatgagcatgggtggaaagttcttcaaatgtcctgggcttaattccttgaaagatgtaacgaagtccccaatgcattccttggatgcacatctctatgccagaagcttcgcttagcctatctttacagttaaagcttgcattcctccatcgattgataaagtcaataactggttcatctttttgttggcgagtgtttgtaagttccacgatgctcacagtacgcctcgtgctataaaagagattaagaaactcttgctccaattggtcccaactatcaatggattcagcctcgagatcggtgtaccaatcacaagcattcccctttagtgagcggacgaactgcttgacaaggtaatctccataagtccctgcattgttgcatgtctcaacaaagtgcgcaacatgttgctttggatttcccttgccatcgaactgttgaaatttgggaggttgatagccgccaggcatcttcaggctatcgattattgcagtatacgactttgcgtacgtgagagaagactttgaagtgacctcatacttatccttgatagttcccataatgaattccttcaattgttctatgggaattgatccttcagaggagacatgaagttctttggcggatgacccttgttttgttggaggatcagccttctcgtggacttcaggaatctttccaggtgcatgacttgattctccatccatcatgctttcaactatgcctgacaattttgcgatacggacatcttgatcttgagcatactttgttaacccatcaatcgcctttgtcaggtttgcaagttgctcctccattgtcgaagtgttagtcatcattgcctccatgattattgcaaatgaccttcccaaggattgaactcagtttggaacatgtcatgtggcgagattggcgtaaagccaacacttaagacttcatcatcaggttgggtaagctgactcttggtattgtataaagtaagttgagcaagaactttctccataacttctacaatattatctcctctctctgacttgctagcagaggacctttcttcttcgaatgatgaagatctcaaagcatgcattggtgcagacgacacttggagtgcttgttgccccaagacgctcgccttgctccgggtgattggcccaagactcctcatagtaacgttcaggatactttcaacgtcagaagaaaacttggagtcagcaacttcgatcttctttgaagccatcttagtgatcttgaatgttgagagttgagaagagatgggaggaagagatggtcccactgggcgtgccaaaatttgtgacaactaaatttcgctcctgaaaaataataatcaagacaagaaatatagcgacaaatattatattcaatttcaagtgatggggttgcaatctctaaaatatctctgaatctaaagagatgtagtcctctgattcttctcctcacggatgatggttcaagagcttgaaagcttgattttgaacttgacggatttcagatttgtagtacgtcacgaagaatttgaagctcgtcacgaaccaagatttgatgttgggttatcacgaacggaagatttgaaaccgcccgcctatgacttgagttcgcctttggaatttgaccacagacgacgattgcagatatggatgaagaccttgatgctattctttagagcttctttagcctttccttctgcttacttgcttcttctttagccttgtcctttgacccctttatataggtgtggggtggagtagtctccaagaaaaccctagtagattattgagcttgaggcttatgggtcaacccatttgatagaagaccaattgacgggctagcccaataatatattggacctttatttaaatcaatttgattggatttaaataacaaacccaattataccaatccatgttacttaattggaccaatatatatttaatttgtggtaaaatccaaattttttatggatttaaatttgacacaattttaattgtctacagacatattcatacccaactggaaattttatgtaaaaaggcttcttgagtgtttgagctaacaaatttattttgcgctgactgcatgttaggaaatcaaaaggaggagacaaatgcccttcctctgtcaaagaaattgctatttatgatgtactatagctggtactcattcatccttgctacttgcatgtgctcttatcatttgtttatttcttttagttgcgaaataagcttgatgactaaggttgagaagtgaagaataaactgaaagaagaattacagtcaatacaatttcggtcataaataaggtttgctggttagtactgttataagagtgattacccagaataggtgtgttccaattggctttcagtgttaaatattaatttgacagtttgtaccagcatatttaacctgttttagatgtttgatgtcctctcacattcacaaaggcatcaaaattggagggaaataaaagtaaatatatactggagatcattggttatcgaaaatttaaaagcacacatgcttgcttggtagtttaggccaattcttctttcttttataaggtggttgaggccagttcttgtccagaataaaagcttatgcacaagtcagaacaccaagcaggcttcccatagaagtagtattttttttatttttttttttggtaagtattattggaataatgcttaccaattaggagtagtattattggaattcaactccattatcatattgcgaagaaagaaaagaaaatgcagtaaaacagaattatctcataacagaaaatcagaaacatattggaaagttcctaaaccgacaacaacagtgacttgtatatttcgctcactgatcttgtttgttgtaagaggggagatgagagaaaaaaggaaaagaatgtaactaaattccttgattaaaggcacaaataatggattaggagcctttttaaggtagattgtatagattttgtaactaaaatatgtttaggtcgggtaaataccaaaacatgaacatttttcgtaacaagattttaaatagtgtataggaatacttaataaataaagtggagatggaggtgaagaagaactcttgggatttttgcgggacagagatatgggtacaaatctgtatataatacattgtgcttgttgtgaatgatggatcctaacttacaaaaaaatgtaattacgagttactactaagggtgtgtttggaataacaaaaaatgttttccgtaaaaaatgtttttcaagaaaatgttttcttcgaaaacaagtagtaattttattcatttttcggtgtttggtacgcaaattaagaaaaataacttttcaagagtattcatatataatttagatataataaacatgaagctagaaactttcaaaccaacaaccttccgaacccatatttttcataaacttttgaatcgctaaatttttgaaatcgcggaatttcgaactcgtaaacttccaaacacataaacccctgaactcataactttggaacttgtaaaattttgaacttttaaaccgataaataaaaaaactaaaactgaaaaatatattaaaaatatatttttttcgggaggggagaggaggggcagggacgggggtgggggtgggggtgcagaaaaatgaaaaaaatagaattttcaaattgcaaaaaaaaaaggtaaaaaaaataattctttttgtcggagggaggatggggatggtgtggagtggggtggaggagtagtagggtgggtggcaacagaaaaactgaaatttgaagaaaaaaaaatcttttttggagagagggggtggtgtagggaaggtgcagaaggagttttggaaaatgttttcccttctcttgataaggaaaatattttcctccgattggaggaaaatgagtttataaaaaaaatattttccaaaacattaaagccaactaaacatggcaaaactgaaaaacattattcaaaaaatattttccttagtaccaaacacaccctaagacatcttaattctatataaaatatcttttaaagctttctaataatggaagtcatagatgaggatcctaggtgagaaagaggaatatttggctcctccttatacctaaaattgtaaaattggattttaatttattattttttatataaatggtaaattgtatatactaatgtgattacgtgataacctctctacgaggggtaaataaatttataatgtatatataggtaaaaattccaacatgaaaatcatattcttactctaaccgagctcccagttccaacatctatataaacaagaaacttcaaatattatacagtcattcttaatattttcaattgaaaaaatcatgcattgtaacaaatattaatagagcttaaattttgtcttaacaattatttaaatattgaaaaaaaattctgacttgacaccagtattgacgtgtttgtactctcacaaaactaggaaatagtgagagacatacaatttggcccttgaaaaagtttaaaacatagagtaggtagcatgcttgcatgcatccatttaaaacttagattattttattccaaaaattttgacactatataaaataatcaaaaataggacaaaaaattgacgtacgagtctaagtaacttaactgctctaaaaatcattcaacttttattataattcttgtgttcaaaaagatgggacatacttaaaattagaatggagctaaaagctagttgtaattgtttatttcttcaattgtggctgtgagtgagctaagaaattaccaaaaggtgagtcacatagtaaactttcttcttcttgtctgttttaaaatattaccaaaagtagaataacacaaccattttctaaaaacaagagtaacacacagcaaagcaaagtgaattactaataacttaatagaaaatatattatttcagcgcatcgcttaaaaaagagtaatcctcatgtgaatccttaaattttttctaacacaacggtaacaagctctaacgcccaacaacaataaaaaaaaactcttatagacacattaaaaagacttaaatccccatgtcatctatcactaaaaaagaaaagacatgaatcagcacaaataaattatatcataatcagacaaaaacattatttattaaaatacctcattttctatattgtttccaacacgtggtggtcccttttcctcgtgaaacagcaattgtgggactgaataaatggatgggttgtgttttcaaatattttagcttttaaattagtattttaattttttttcttaaaattaatttttatcatgtcactaaattttaatgaaaagcacataatccgacaaaaatgaccatttaaatgaactataagttatgtgattattgagaaacaaaaaaattacatgactgtaatggttaattaccaaaaatgagtaaccatcaaggccatccgtcgtacgtcttataagttataagaccacaatcacaaatgaccttctttaagtaattcaacaaaatgcatttcactttattttttgcgccgaataaatatacaaaaggccgaatccgaattattccaagagatgttggaaaatattagtttgtccgcttaatgaagcaataatttggctttgtcaccactacaaacttgtagagaaaaagatatgttaatattttcaggataatacatatagagagagagtcgtacctttctataacagcctcgttagttccgaatatttttgtatgttatagcgaagtgttataatagagaacatatattataaaataacatgaaatttggttccgaaaaacttgatttttatagtgaagtattgttatatggggttgttgttatagagaggtatgactgtatgtatgacttatttgtataaaaaatgatctagaagataaatgtgggcgaaaataatttagtagtcaaataatacttaaaaaaaaccatagcacatacaagcaattgaagtattaaaatggtgaaagggttagttgaggtgcatgtctgatcgttggggacaacttaaagagtccgtttaaatatttcgtcgttttaatactacagggttatatttggccgtttcctaaattaaatggtttaaattttgaaacacttcaatgagtaaaaaacccttgtcagcttgtatgtgctgttgcattgctattacgtcttttctcccaccggactattttcttacgcattaaacaagcaaaattattttattgaagatcttttgaaatgacccggattagaataattcaaggaagttatttactaatcaattatagaactataaagtattatttcatttgtgttgtcttatgcgcatggttgttaggaagaattattatttttaaaaataatgaaaactcgaaaaagtttaatgattcatatgatttgggtcgtcgtagaaaaatattacaactactccatcagtaatatattttatcttatagcctattagtctctttcgtgtaataaaatcacatgtgatgtataaattagctagggtttaaaatataaaataaatatcatccgtacgttttaagatatgttttttttctatatgctaacatactatattcaaattaaatgtcttaataatacttttgccaagtctgttcagacgtccaataccaataattgtgagatatttcttgaaaattaaccacatttcaacaaattaggaatttgtgatgaccttttgtcatcacttgttttaaaagtaaattctgcgttccgatgcctcaaaaatatctttctatctcacatcgatttgtgtgcgcagtctgagcgcgtagccggaaaaccaatatgtgaaaatctgtgaaaatgatgaattttgactttaaaatgaattaagttgacttcgctcaacattttggttaaacggacatagacccgtgattcgacggtcccggagggtccataggaaaatatgggacttgggagtatgcctggaatcaaattccgaggtcccaagcccgataaatgaatttttaaagaaaattattttctggaatatttatgaatttttgaaaatgaaatgtgtttgaaacttgatggtatcgggtacgtactttggttccggcgcccggtgcaggtcttatatgtgatttaagataagtctgtgaaatttggtaataaacggactcgagatgacgtgaatcagatcgtatttgagaaaattggaaaatttgaagtttttaagaaatttcatgattttgatgctaaattcatagttgttgatgttattttagttatttgaatgcacgagcgagtctgtatgatgtttttaggttggtgtgcatgattggtttggagctccgagggctcgggtgagttttgaataggccacaaggtggattttggacttggaaagttgcagacttcagctgttgtattgcaggcctgcaggcttcgcatttgcgaagcctggctcgcaaatgcgaaggctatgtcacaaatgcgaaaatagccccggccagccttcctcgcaattgcaaggaatttatcgcaaatgcgatatttcccccttttggtcagtcgtcgcaaatgcgacgtgtagttcgcaaatacgaacttagcagaagtctgggttcgcaattgcgaaccttggtagcaattgcgacatctgcaacctgcaattttataacttagccgaaaatctttcatttttcacactctttcaaaaccaaaaccctcttgggcgatttttcaaagacaactcttcttccaaatcaattgtaagtcaattttaactcgttttcttcaatcattaacatcttttcacatgatttcaactcagaatcaatgatttttatgggggaaattgggtgttttgggtagaacctaggtttttcaaaaattggggatttagacctcgatttgaggtctgatttcaaaacaaattatatatttgagttcgtgggggaatgggtaatcgggttttggttcgaacctgggttttgaccatgtgggcacgggggcgatttttaactttttaggtaaaactttagaaaaattatttcatgcattagaattgattcatttagcatttattgatgtaattaagtaacttgtgactagatacaagcgaattggtggtggaatcaagaggtaaagcgatactagagacttgaattgtattcgtggcatcgaggaaagtgtttggcctaaccttagcttgagggattaggagtcgagtcctattttctatgtggtttttgttgagtacgacgtataggcatggtgacgagtatctatacgttggtgtcaagcatgaccgtgagtcttatattgtgattattatgacttcgttgtattattcatgctttggtgatgatttatattgttgggcaaagtttgtggaagtaattgtgacatttgaacattgaggagcattggctcaagttgtataatgaaatgtgaaagtataagtggtaattgaaccttttagagcattgactcaagttgtgaggtgagttgtgaagtaatagtgagaaaaagaaaagaattattatgtggcctcccttgccgggatattgttgcttttgatgttatctcccttgccgggatgttgatgtttcttttgatgttgttcccttgtcgggacttgattgttgaactattgttcccttgccaggattcttattgtaatttcatttactcccttgccctattgtttgtgattgttgtttgggtgaggaagagtgttaaagcacgaagggtgatgtcctgtattgtttggtgagagagtgttaaagcacgaagggtgatgccatgtatgatttgtgaggaaagagtgtaaagcacaaagggtgatgtcgtgccgcacgatgtaccattccatgccgattatattgattatacagtaaggacgagagtaaaagcacaaaggatgatgccatgcacattttcattacttgattgctttggtgaggacgagagtaaaagcacgaaggataatgtcgtgcacttattgattcctaattctttgttgatatctgagatatgtcgtttcttttaattacccgttgtcttttattctaaattgatagttctccgcagcatgttacccatctcatactttactatataatattgttcttcttttccactgtatataattaaattacacaggtttatttggtagtctggtcctagcctcataactgcttcgtcgaggttaggttaggcagttaccagcatatagggtcggttgtgatgatactacactctgcactgtgtgcagatcccggagcagcagcttttggaccgtagattgggtggctgccttcagtccacacggagatccaaggtagtcctgtaggagttcgcaggccctggcgtctccctctatccctttgctcctatttcatttacttagttcagaaacagtgtatcttttatctttcagactttgtatatagtattcttagatcgtctgtgaaactgtgacaccagttctgggtggtcgaggctcaaatagttgtattagatacatatttaggatagtttactacatttcttccgcttattgtaattttcgctgtctacacgttattgctttataattgttaaagaatataaattggtaaaaaggtaatttgttcaaacagtcgacttacctttctcacattagtaggcatcatcacaactcccgagggtgggaaatccgggtcgtgacaagttggtatcggagctctaggtaacatgggtctcacagttcaaagacaagcttggtagagtctgagggatcggtagagagacgtctgtatttatcccctagaggctacaaagttagaaaaaacttcacatttattctttcttatcgtgcggtttggtttctcaatgctaattggatttctattgtattctttcgcagatggcaagaacacgggcttcctcatccactaaccaacagctcgagcccccagcagtagctcccacgaggggtagaggttgaggtcgaggaagtgctagaggccaaggtaggggcagagctcagcctagagcagcagcaccagtggcggagcctcaagttgactttgatgatgaggttccggcctcggcaattccggtgggcccaactcaggtcctagaggggtttatggctacccccatactctaggatgctctggtctgtctagtgggctttatggagagtgtcacccgggcaggctttcttcctatagcactaaccgtctctcaggctggaggaaaagcccagactcctggtactcacactccagagcaggtagctccctagtttcaaactccaacagttcagccagttggagcagtttagccgggtgtggtagctctaaccggtgatggagcagctttgtttgccgatgctttgtggaggttagacaggttcaccaagctcttcactactactttcagcggtgcatcttctgaggatccccaggattatctagacaactgtcatgagattctcaggaacatggggatagtggagaccaatggggtcgattttgctatttttcgcttgtctagatcctccaagactttgtggagagattattgcttggctaaaccagtcgaatcaccaactttgacttgtgagcagtttactcaactatttctggagaagtttctccctatcacacaaagagaggcctatcggaggcagtttgagcgtctccagcagggttctatgaccgttactcagtatgagactagattcatcgacttggcttgtcatgctcttatcatacttcccaccgagagagagagggtgaggaggttcatcgatggacttattcagccgattcgacttcagatggccaaggagacatggagtgagattactttctaggaggcggccaatgtggcctggagagttgagatggttttatcgcagggaggtagtcaggggtctaacaagaggcctcgtcatttaggccgattcagtggtacctcgtctggaggtagagattcgtatggtaaaggccatcctcctaggccttttcagtcagcacttcaggtttctcacagtgcttcagttggtcatggttcccatatgcagtattctgatcagcagtcctatagtgcaccaccagctcctatcagtgcaccgtcgctttagagtttttggggtggtcattcaggtcatcagggtcaatagtctcagcagccgagggcttgttacatatttggtattgctaggtttttctctcgagcaccgagtagctctcaacatcagggttcttgtaccatggttcaggtattgagtgttccacagcctgtccagccagttagaggtgggggtagaggtgctagaggaggaggtagaggtattagaggtggagctcaggccactagaggtggagaccagccagcagcaggccatcgtagagatgtagttcagggtggtggggcccagccccgttgttatgctcttccagccaggatcgaggctgaggcttccgatgcagttatcacaggtactgttctagtttatagcagaaatgcttcagttttatttgattcgggatctatatactcctatgtggatcttattttgcaccatatctggtcatgcctagtgattctttgggtgctcctgtttatgtgtctacacctgtgggtgtatctattgtggtagatcgagtccatcgttcatgtatagttgtggttggaggtcttgagactcgtgtagatttgcttcttctggacatggttgatttcgatgtcatattggggatggactggttatcacgctatcttggattgttatgccaagactgtgaccttagtcttgccgggtttacctcgtttagagtggagagggactcttggtcattctatctgcagtgttatctcttatgaaggctcgacgtatggtcgggaatgggtgtttggcctatttggtctaagttcgtgattctagtgttgaggttccttctattgattctgtacccgttgtttatgagtttcctgaggtattcccttcaaacctgccaggtatgctacccgacagggataccgacttttgcattgatttagctctgggcactcagcctatttctatctcgccgtatcgtatagccccgcttgagttgaaagagttgaaggagcagttgcaagacttgcttgagaaaggtttcattagaccgagtgttttgccttggggtgcgccggtgttgtttgttaagaagaaggatggatcaatgaggatatgtattgattaccggcagttgaacaaggttaccatcaagaatacgtatccattgccgaggattgatgatttgtttggtcagcttcagggtgccaaggtattctcaaagattgacttgagatctagcttccatcaattgaggattagggcatctgatgtccctaagacagctttttgcactcagtacggggattatgagttcttggtgatgtcattcgggttgataaatgccctagcaacttttatggatttgatgatccaagtgtttaggccttacttggatttgttcgtgatagtcttcattgatgatattttgatctattcccatagacaggaggagcacgagcagcatcttagaatggttcttcagactttgagggatagtcaattatacgccaagttttcgaagtgtcagttctagttgagttcagtggcattcctgggtcatactgtatcagcggaaggtattcatgttgatctgaagaagattgaggcagtcaagaactggcctagaccagcatcagcaatagagatccagagtttcttgggattagcaggctactatcgttggtttgtggaggggttttcatctatcgcagccccgatgaccaggttgacccaaaagggtgcccagttcaggtggtcaaatgagtgtgaggcgagctttcagaagctcaagacaactctgactacgacaccggtgttggttttttccacaggttcagggccctacacagtttattgtgtgcatctcgtattggacttggtgcggtgttgatataggatggcaaggtcattgcctatgtttcgtggcagttgacgattcatgagaagaattatctggttcatgatttggagttagcagccattgttcacgcattgaagatttggaggcattatttgtatggtgtggcatgtgaggtattcatggatcacaagagtctgcagtatttgttcaagcagaaggagctaaatttgaggcagagaaggtggttagagctactaaaggactatgatatcaccatcttatatcatccgaaaaaggccaatgtggtggccgatgctttgagtaggaagtcagccagtatgggcagtcttgcttatattccagtcggtgagagaccgcttgctttggatgttcaggctttggccaatcagttcatgaggttggatgtttctgagcccagttgtatgttagcttgcacagtcactcgtttttctttattggagcgtatccaagatcggcaatatgatgatccttatttgtgtgtccttagtgacacggtacaacacggaggtgccaagcaggttaccttaggagatgatagagttttgagactgtagggtcgagtttgtgtgcctaatgtggatgggcttcgggagttgattttagaagaggcccatagttcccggtactctattcatccgggcgccgcgaagatgtatcaggatttgcggcagcattattggtggagaaaaatgaagaatgacatcgttgcatatgtcgctcgatgtttgaattgtcagcaggttaagaacgagcatcagagacctggtagtttgttccagaagattgagattcctaagtggaagtgggagcgaatcactatggacttcgttattggactcccatggacttagaggaagttcgatgcagtatgggttattgttgataggctgaccaggtcagcacatttcattcctgtagcagtctcctattcttctgagaggttagctgagatctatatccaggagatagtccgtcttcatggtgtgcccgtgtctatcatttcggaccgaggtacgcagtttacctcccatttctagagagaagttcagtgagagttgggcacacgggttgagttgagcacaacatttcatccttagacggacaggcagtccgagcggaccattcagattttggaggatatgctccgagcttgtgtcattgactttggaggctcgtgggatcagtttttacctttagcagagtttgcatataacaacagctaccagttgagtatccagatagctccttataaggctttgtatggtaggcagtatcgatcgctggttggatggtttgagccatgggaggctcggttgttgggtacggatctagttcaggatgccatggataaggtcaggattattcaggataggcttcgtacagctcagtacaggcaaaagaattatgccgaccataaggttcgtgatttggcattcatggtcggtgagcgggtattgcttcgagtgtctcctatgaagggcgtgatgagatttgggaagaagggcaatcttagccctaggttcattggcccgtttgagattcttgatcgagtgggagaggtggcttacagacttgcgttgccgtcgagtttatcagtcgtgcatccagtgtttcatgtgtccatgcttcggaaatatcacggcgatccatcccacgtgttagatttcagcactatccagttggataaggacttgtcctatgaagaggagccggtagctattttagaccattaggttcgtcagttgagatcgaagagttttccttctgttcgtgtttagtggagaggtcagcctaccgaggatctacctgggagtctgagtctgatatgcggagccgttatcccatcttttccccgactcaggtacttccttcttctgtctgttccaggacgaattgttgttttagaggtggagaataaaaggtcatcacttgtttgaaaagtaaattctgtattccaaagcctcaaaaacctctttatgtctcaccttgatttgcgtgcgcagtccgggcacgtagccggaaagccaatatgtgaaaatctgtgaaaatgatgaattttgactttaatatgacttaagttgacttcggtcaacattttggataaacagacccaaactcgtgatttgacggtcccggagggtccgtaggaaaatatgggaattgggcgtatgctcggaatcgatttccgaggtcccaagcccgagaaatgaatttttaaagaaaattattttctggaatatttatgagtttttgaaacttgatggtaacgggcccgtactttggtttcgtcgcctggtacaggtcttatatgtgatttaagataagtctgtgaaatttggtaataaacggactcgagatgacgtgaatcggatcgtatttgagaaaattagaaattttgaagttcttaagaaatttcatgattttgatgctaaactcatagtttttgatgttattttagtgatttgaatgcacgagcgagtccgtatgatgtttttaggttggtgtgcatgattggtttggagccctgagggctcgggtgagttttggataggccacggggtacattttggacttggaaagttgcagacttcagttgttgcattgcaggcctgtagtctttgcgaagcctggctcgcaaacgcgaaggctatattacaaatgtgaaaatagcccaggctagccttcctcgcaattgtgaggaatttatcgcaaatgcgatgtttcccccttttggtcagtcgtcgcaaatgcgatatgtggttcacaaatgcgactttgcaaatatgaaggtctcctcgcaaatgcgaacttagcagaagtctgggttcgcaattgcgaaccctggtcgcaattgcgacatctgcaacctgcaattttataacttatccgaaaatctttcatttttaacactctttcaaaaccaaaaccctcttgggtgatttttcaaagacaactcttcttacaaatcaattgtaagtcaattttaactcgttttgttcaatcattaacatcttttcacatgatttcaacttagaataaatgattttcatggggaaattgggtgttttgggtagaacctaggtttttcaaaaattggggatttggacctcgatttgaagtctgatttcaaaacaaattatatatttgagttcgtgggggaatgggtaatcgggttttggttcgaacctggtgttttgaccatgtgggcacgagggcgattttgactttttgggtaaaactttagaaaactcattttcatacattagaattgattcatttagcatttattgatgtaattaagtaacttgtggctagatacgagcgaaatggtggtggaatcaagaggtaaagcgatagtagagacttgaattgtgttcgtggcatcgaggtaagtgtttggtctaaccttagcttgagggattaggagtcgagtcctattttctatgtggtatttgtttagtacgacgtataggcatggtgacgagtatgtatacgttggtgtcaagtatgcccatgagtcttatatcgagattattatgactttgttgtattattcatgctttggtgatgatttctattgttgggcaaagtttgtggaagtaattgtgacatttgaacattgaggagcgttggctcaagttgtgtcacgacccaaattccactaagggtcatgatcgcgccgggcaccgctgtcgggcaagacaaccgaaatacttgattaaattctcgttttaatatttttgaaaactataatttccttcaattttactagtaaaagataatcatttagaatcaactatgaatgttaataagttaatacaagacaccctataatcatcccaaaactcggtgtcacaagtgcatgaacatttactagagaatgcaataaaatacagtaactgcccggaatacaagtggacagaaatgaaaaacacagtaaaatactctgaaggggactctgctggccgcgggtcgtctcgataaatgcaactcacctaagtctccgtacaaaccatgccattatgccactaagccactagccacacttgaacctatgcatcaaaaatgcacaacaagtgtagtatgagtacgaaaataatgtgtacccaatgagtatcccatctaatctcaaagaagtagagacgagaggtcaacttcaacacttactagtagtccaatgataatataataaaaaaaattgggtggagatcatggattttataaagcaattataaactcataaagccaaatagcaggtagagaacttctcaataataaaagggtttccaaagatttacttttcattatctttatccatttatctctggccaggaaaggcaagaatcaacattaaaaattcttaggcaacaatataagtatacacatatcacgttgaggtcgtatggcccgatccaacataaatgtaaaatgtgcaatgtcgatggtcaaacggcacgaaccatagatgcatctattaccccactcgcgaatcatacatgtgacgtggtcaacataaataaacaaatacccccgctcgtgaatcatacatgcgacgcgagcacacatagacacacacaatcaagcaaccaattaagaatttatcggggaatgtttatccaaataaaagccaattctcttttaatgatttaagaaaatgaagtttaatccgtttagaaatttatttaccaattcgataggatttaggcaattcaaatgtcaataagattacaaatattccaagtatagcatgcttttgggtcctagactacccggacttacacataatagtagctacgcacagactctcgtcacctcgtacgtacgtagcccccacaaataggagcacataaccaattatatcacctatggggacaattcccttttacaaggttagaaaggagactaaccttgctccgaagatccataactggcattccacgcccttccgaagactcgaatcgatgtacaatactccaaaactagccaataattatgcaaaatccattaatatatgctcaattacccctaatgatctagtttaaggccgatccgggtggaagacattgtcaggtggggagtttggctggggcagcacatctgttaaaagataacgcatgtgtcctaagatgagctcaacgagaacagaaatctcgtgtggaacagaagggtaaaagctcgtttaataatttctaaccccgatcgaaaagttgacaaatgggccattgggcccacgtgcccggattccaaaaatttttgaagattaagtttacccatagcctcacaaactcaaatatataatttactctcaatctcatacccaaaatcgtggtcaaaattaaagaatatcaaatttctaggccttcctcaaaaccccaaatttctacaaatttccttgtcaaaatccatatataaaccttgtatttactcaaaactagtagaaatcacttacctcatgcttggtgatgaaacaatggcactccaaagttgctctaaaatcggctcccatggaaaaatgaagtgaaaatgagccaaaactcagattttaaaaaaacactgcccaggcgacccttcatcgcgaacgcggaacatccctcacgttcgcgaagctcaaaatttcacgcccagaaaattcttctcctagtttgcaacccgctgatcgtgtttgcgaaagccagctgcccagacccatcgcgttcgcattatcctctacgcgttcgtgtaggttaaatggccttgggcgcagctctcccttaccttgttcgtgctcgcatagccttggttgcattcgcgaaggctaaactcagcagccttatctactcctcttcacgaacgtggcactcccttcgtgttcgcgaagaaggaaactagacaccagcaaacatctgttcaaaaacagcccgtaatgctccgaaacaaccccgaaacacacctgaggcccttgggatcccgtctaatcataccaaccagtcctataacataacacggacctgatctaggcctcaaatcacatcaaacaacatcgaaatcatgaatcaccctccaattcaagcttaatgaactttagaatttcaaacttctacatttgatgtcgaatcctatcaattcacgtccgattgacataaaattttgcacacaagtcatattttacattacggacatactccaacttccgaaattggatttcgaccccgataacaaaaagtccacttccggtcaaacttctcaaaaacgttcaaatttctatctttagccaaatgactccaaaatgacctacggacctctgaattcacttccgatcccgctcccaatagcagaatcaccatacggagatattcccagactcagaatcccaaacggacattgataacactgaaattcgcttcaacctaaactcatgaaattcttccaaaatgctaacttccacaataggtgccgaaacgttcccgggtcttccaaaacccggtccgaacatacgcccaagtccgaaatcatcatacgaacctactggaaccttcaaatcccactttcgaggtcgtttgctcaaaaattcaatcttagttaattatttcaacttaaaacttctgaaataagaattctctttccaaatcaactccgaattccccagaattcaattccgaccatgtgtacaagtcataatacttgaagtgaagctgctcatggcctcaaactgttgaacgacatgctagagctcaaaacgactgatcgggtcattacattctctcccacttaaacatacattcgtcctcgaacgtgctaagaactatgttggagttgtccgaaatcactgtttaacacctcgagcacctacccgtgctaccacaactcagctgagcaccctagctcgatcaatctgaagatatcctttttcacttaagcaaataagccatagagcccaattctaatatccggaattttctgtcacgcctgttccaacatactctcaccgtatcaatagctacacgcaacaccaaaacatgactgcataccttagctaaattcacaccttgcaccactttactcacaggaccacaataacattctctgatcaaattagtcgaaattccacaaattttatgctcccattgcacctcatgacatacataggtcttgctctaactcttacaatactgccacgaaggaagagatgtgtagaaattcataaccaactgccgaaccaacaaatcattgggtctatactcctgtcaggaaccatcacctcattctgaaccaaataatggtctttgctccttaatatacttcatataatcagattgaaatgatcctaaatccaatgatcttgtctcacccagtacgaactactcaggtaataagccacaccggacatgatcaaaagtttcatatgatgccacaatgtgccaataggctaccaattcgaacgcgatgcaaaaggaaaacgaactctgaaaaggaaacccaattaccccgctcgcgaatcatacatgcaatgcagtcaacataaataaacaagcaccccactcgcaaatcatacatgcgacgcggacacacagctaatatgagttttcctcagaaaaaataggaaacaaaacacatgaaaacagatatagggaactgtactcaacatcacactgttgcggcgcgcaactcgatccaaacagcatatccatggcagcgtgccacccgatccacatgtaaaattcacataaggagatacataccgagctagattgctcattacaacaaaataccgaatgtcgctcacgagcacgctaagtgcataatactatccctggggagacatatagcgccacaagctacgaactcaagcacaactgaggtgcgatatacgatctaaatctcaagagccatcctgctcatataacatcatcactgtgtggaacctcaacacataagaaattcgccaagccatctcacaactcacatggcgcaatatatcattacatgaaatagctaaagacgaaataacactcccactactctcccataaggagctcattgctgaaatgaacacatcttgcctgatattgagcccatattcacatttaaatccattcacagacctcaagctgattctaatcgcactgaactaggctaataacctttcaaaggtccataataaccctccttttctcataacacacaagaactaccatcataaccagagtaatccttcacagtccacaacccaataaaccgagtgccctccgggcatcaattctcaaattaacgacatcaccgaaatcttcatacttggtttaactcttcaatcaatcaagtgactataccacacttatacaatcttctcgtggggcacgctcccacaatcttccatgacatataacaggtctgcatctccaaacaactggtcgcactaacgctgaaaagcgataaagaatctataaccaggaggtagggcctctttcacaaaacaccgatctctggtgaggctgaagacaatgccatcttactctaaacattcaaatcatctttcctgctcatctgagctcgtgacatccttgtcaataccaaactgcgaccttgatcctcacttcaaattccataccactcactgcacccaacatgccaatatgcgacagaataagattttcatcataacttcggaaccactaatagattaacacttcatcatataaaaacttttcacttaactcactttaggagacccatagcaacacacaggtgaattctcataactgtagaatatacaaatctctaagtagtggtctaagccaccatagcctttccgggatccgcctacacataacaggccaaaacagtagaatacttctgaataacatcaattaccgcggccgacaagcctcgcacgtaccgtcacaaatcacttgcataacttgatcacgctacaggaactaatcactacaccaatatgccaattcaactatggctagcaaatctatcttcgtccaatttatccttgattgcctttgaaataataataacaccattcaacacatagctcactccatccgtactcatcctgagtgaccttgaatcatgagaccatgctgtctcaaattccacgaactatttcatacctcccttgtacgcacatttgcatcctcaactagtacgcccactatgataatctctctacgaatccgaagtcctttctcattcctcccaaatgcagcactgcaagtcaaaatatctagaacattttgggcctcttctcataagctgctacaaagcttgatccttaaccatatctataggctcgaaatcattaggtaccacactttacccctttgaatccaccaggaccgttgttgagagccacccgctctgacttggccccgaatataatcaactccatgaatcttctagcacatgaataccctctcgacgaaacacccagcagaatcactttccttgaaacccacatctatacaaggcataaatcctgaatccgtcccaagtctgaacataagccaataaggccaaccatagcacacctttaacaattcctttgctcaaattaccacttatgttctttttctgtagctgaaataacacattaatatgctaataaccagaaacctcggaagtagttaaccatgcaacccaatcataggtggtgagactctcccacttagcttgaagccaatattacacacctctggaattcaccaggattctttatcttttattgacatgaccgcgcgtaatcaattgccaaaattctcggaatctttctatgaaacctcattcttatactctgaatcatcaacaatatttgcatgaccgatctctttgttgtataatcaatagaaatcttcgcagaagcttcgccaaccatgcgaccaccgatctgctcactggagataacccacctatggaatttacgtgcctgcatcttccaacgctgctgcatggggtacaatcactatgacatcaataacccatcccgagtctgagctcactctctagctgcacaagtccattcacccttgttgacatcaattaaatgtgcggcaacatccttccaattcaaagttatgttgtattcttcttcatttcaagaagctcctttccgttatatcaaatctccttccgcataatagcctatacttcaaattaaatctgtagacaccaatcaccaatcactaaattcccaaatcattccaaactctccttaatgtgcgtagtcatcctaccacaaagcccatatgcaactccgccactctcccactttggtggaactcaccccctttaatcaactactcaacctttgcctcttatacttggccttctcgaaattttaaccatcgcctgacactccctacatgtctttcctcatcctttgctgctcagttgttgccttaaataaaatctaccttcgtagcgcttgaacccacgaaccactactaactttaaatctccccgaggtcatctttcttagaccatcaatactagatatactgattcaatcctgaaacaccgcacatcgcgatctctgacagtcgcctctccattattatttcacaatatcctgccccaaaggcgaattgaagaaaaccataacaccggagagctcaacatattcaatcaaggacgacaataccacgtcacagatgaaaattccaccacgcttgaaaataccaagtctcattactccatcaagccaaacttgaacatctatagcctgattgcctcacttccgcccggaaataaaattctgaagctctgaatcttgcattcagtaaacatccttccaagtcattcactgcttcaacacatagacaaacactctaccattacaccaatattgtgcgataacaacgcacgaatcgtcataacaattaattccaaatctcaaaaccttaggtaatattgaaattgagctgaaacgatagaacgaccttccacaaggcgacgacaatagcccgatcaaatacgcaggggggaacatcccgcaccacatctgtagtaccattacattttctcaattcccaatttataataagtgcttcacgtcgcataagattgagtaagaaataaacaaaggaataagcctcaaggaatcaaatcacacgatgaggaagcaagaagggaggtgctcataacagtcctgtagcctctcgaagataagtacggacgtctccgtaccaatccgcgagactctactagacttgctcatgaatcgtgagacctaagggaacctagtgctcagataccatgttgtcacaacccaaattccactaaaggtcatgatggagccggacaccggtgtcgagcaagccaaccgaaatacttgattaaattctcgttttaataattttgaaaactataattttccttcaattttactagtaaaagataatcatttcgaatcaaatatgaatgttaagaagttaatacaagacaccccataatcatcacagaactcggtgtcacaagtgcatgagtatttactagagaattcaataaaatacagtaattgtctggaatacaagtggacagaaatgaaaaacacagtaaaatactctgaaggggactctactggcagcgggtcgtctcgataaatgcagctcacctaagtctctgtaccaaccatgccattatgccactaagccactagccacacttgaacctgtgcaacaaaaatgcacagcaagtgtagtatgagtacgaacacaacgtgtacccaatgagtatcccgtctaatcttgaagaagtagagacgagagatcgacttcgacacttactagtggtccaatgataatatagtaaaaacaattgggtggagatcatggattttataaagcaattataaactcataaagccagatagcaggtagacaatttctcaataataaaagggtttccaaagatttacttttcattatctttatccatttatctctggccaggaaaggcaagtatcaacattaaaaattctcaggcaaacaatataagcatgcacatatcatgccgagttcgtacggcccgatccaacataaatgtaaaatgtgcactgccgaaagttgaacggcgcgaaccatagatgcatctattacccctctcgtgaatcatacatgcgacgctgtcaacataaataaacaaatactccgctcgcgaatcatacatgtgatgcgggcacacatagatacacacagtcaagcagccaattaagaatttatcgggaaatatttatccaaataaaagccaattctcttttaatgatttaagaaaataaagtttaatccttttagaaattcatttaccaattcgataggatttaagcaattcaaatgtcaataagattacaaatattccaagtatagcatgcttttggatcctagactacccggacttacgcataatagtagctacgcagggactctcatcacctcatgtgtacttagcccccacaaataggagcacataaccaattatatcacccatggggaaacttccctcttacaaggttagaaaggagactcacctcgctccgaagatctataaccggcattccacgcccttccgaagactcgaatcgatgtacaatgctccaaatctagccaataattatgcaaaatccattaatatatgctcaattacccctaatgatctagtttataataatttctaacctcgatcgaaaagttgacaaatgcgccctccggcccacatgcccggattccaaaatatttcgaagattaagtttacccatagcctcacaaacacaaatatataatttactctcaatcccatacccaaaatcatggtcaaaattcaagaatatcaaatttctaggtcttcctcaaaccccaaatttcaacaaatttccttgtctaaatccatatataaaccttatatttactgaaaactagtagaaatcacttacctcatgcttggtgatgaaaatgacactccaaagttgctccaaaatcggctcccatggaaaaatgagtgaaaataagccaatactccgattttaaaagaacactgccaaggcgacccttcatcgcgaacgcggaacatctctcgcgttcgcgaagctcaaaatttcacgcccaaaaaatccttctccgcgtttgcaacccgctgatcgcgttcgcgaaagcgagctgcccagacccaacgcgttcgtgttatcctctacgcgttcgggtaggcgaaatggccttgggcccagctctcccttaccttattcgcgttcgcgtagccttggtcgtgtttgcgaaggctaaactcagcagccccatctactcctcttcgcgaacatggtattcccttcgcgtccgcgaaaaaggaaaccatacactagcaaacagcagtcccaaaacaactcgaaatgctctgaaaccatcccgaaacacacccgaggcccttgagaccctgtctaatcacaccaaccagtcctataacaaaatatggacctgttcgaggcctcaaatcacatcaaacaacatcgaaatcatgaatcaacctccaattcaagcttaatgaactttagaatttcaaacttctatattcgatgtcgaaacctattaattcacgtctgattgacctcaaattttgcacacaagtcatatttgacattacggacgtactctagctttcagaattggattccaaccccggtatcaaaaagtccacttccggtcaaacttctcaaaaaccttcaaatttctatctttagccaaatgactccaaaatgacctacggacctccgaattcactttcgaatacgcacccaataccacaatcaccatacggagatattcccagactcggaatcctaaacggacattgataacactgaaatgcacgtcaacccaaattcatgaaattcttccaaaatgctaatttccacaataggtgctgaaacgttcctgagtcttctaaaacccggtccgaacatacgcccaagtccaaaatcttcatacgaacccgctggaacctgcgaatcccacttctgaggtcgtttgctcaaaaatccaatcttagttaattcattcaacttaaagcttccgaaatgagaattctctttccaaatcaactccgaattccccggaattcaattccgaccatgcgcacaaatcataatacctgaagtgaagttgctcatggcctcaaactgttgaacgaagcgatagatctcaaaacaattggttaggtcattacaagttgtataatgaaatatgaaagtataagtggtaattgaaccttttagagcattggctcaaattgtgaagtaacagtgagaaaaagaagagaattattatgtggcctcccttgctgggatattgttgcttttgatgttatctcccttgccgggattgtcacacctcctttttccgccttgcgaggggtgaaggagttttttccaattaaaggacaatcgaaacgggatttgtttatttatttcagagtcgccactggagagatttatggtgtcccaagtcaacggttgaatcccgaatcgaggaaagaatgactctgtttaacagtccgcgaatcagaaatccggataaggaattctgttaacccgagagaaggtgttaggcattcccggattccgtggttctagcacggtcgctcaactattatatttggcttaattatctgatttttttttaacaattaaggacttatatgcaaatttaactttgacccgcttttataattattgttattattattattttatacaataattgcaacgttgggaaaacgtatctcgaatcacgtcacaaccagtgtacacgtgatttgttgacgcattttgactccgccaagattgggatttgggctacataaatgcacacccatatttaagaaaatacctttattaaatacaaaactaaagactacggttatactttgtattgtttatatttgtttatttttttttagcgaaatcttcccttattttatgaatatcttaaaatgactacatttttcattattaagtttgtctataaatataaaatcaatctttacatacttaaaaataacatattaaatatcagtttaaaacaaatattagcggaaaggaatattactaaaattgtaattataaatacaatatggaattgtcaaataattttttttttaaaaaaaactaattatcccataaccggattaaaatcatattgttagatgacttgagctattgaaattaattatttacactactgaaaattagaaacaatcttgattactaatgcgtatttctaaaatttaattaatttaaccttaactaacctcgttttaattcaaatcatgtcctaatacttgattcgcaaaattaatttaaactcatgttttaactaaatttagctacatgattttgattaacttaatgttggtgatactaaaacccttatgaatagtgaacttaattaattttgccaaacagatttaataaagtcatttttacgttattttcttctcattctaattattagacagtttaatcagtaatgaacatgcttaaatatatactatctaataatcagattaaagcaaagcattatttaatacatcgctacaatatgtctagttatgcaaaacgacggtgatttacagaatagtaatacatgaaataacctaaatacaaaaaaaaaagctaaattagaaatttaaaatctcattcttcatttcagcttacaaaatgccaagattacagttgtgtacctggtattgccaatataagaagaagaaagtcagcaacgtagtacgtaacacaacaatagcaataataaccagcaatccagtcaacagaaaatcccagtgacagatttgaaaatcaagataaaaatccagaaacaccgacaacaaacaacggacagaagccaagggaatcttttcagatttgaaagactaattaatatttaacccttaatttctgaacacgtatatcataatatttatcaggtgtatactactctctcttttaatttccagcccttttttattttgtatattttttttcttttttgaaagtcttaatatttttcggaatttttctttctctctcttcaatcttcagccctctttttttctctgtctccttctttataatctgatcaagtccccctatttatccccatctttcagcattttttaaatataaaactcactatcttcccattcatcccccttttaatcccactgcttaatgtattgtctcctactacattaaacaaataccccattatatcatgtcctccatgcttatattaaacaattgtattattcccaccattatatcttgtccccccattattgattattttaatattattttaatcctaattaacagagcactcaaaataaataattgttcagaattttaattccaaaaatacccctctgaccttactgaaattaacattttacccctgaacgtactgcaaattaccaaactacccgcatcagttataaccaattcacctaatcaatttcaaccaaaatacagcaaatatgactaatttctaaacaattttcaacaacaaattcaaactaaatgatgaacaaccaagaaacaactaaaattattttgattgaacaatattttttaacaacaaacaaacctactttcagattcaacaacaacaacaacaaacaagtatattcagatttctatattcaataattatttgaacttaaaattaaatctaacaacattacaaccaacaatttctatattaaactaaacaagatcatgaaacaaactgaagaaataatcataaatgataaacaacaaacaagaaaatcaaacttatgctaatttcggattcaagaacaatcaaacaaagtatggacataaatgaaaagattcaacaacaataacaaacaagttttattcaaattcgaattaaactcgaattaagcttaaacaaaacaaataaacatattcaaatcactaaacttcaaataatcaattgatctttttaaattaaatccaacaaaattataacaaagatacattgaatcaaaaaattaaaaaccaaaacataacttcacattaaatcactgaattaaaaacgaacttcaaacaaaataaacacgaattaaatctatattaaacaacaaacatgacagattcaaatgatttaaactaacacttttctatattaaaactaaatccttttaaattaataaaacaaactgaagaaataattaattgaacttcaacttaaatctaaaaacattataattaaactaacaatttctatctaaaaataaataagaaaaatgaaacaactgaataaaaatcaagaacaagaatcaaacatttaatgatttcagattcaaaaaatatcaaacaaattacggacaaaatgaaactcaaaccaactaaccggatcggaacgacgaagaacttgaatgaaaacaaatccgtccggaatcgattatcgcaccaaaacaattcgacgccgaagacgacccagaacggaccatcgaagaacttgaagaaggaagcagcggacagtagcagcagtgaaggatgaagaagacgcagcagcaactcgtcgaggcagcagtagcgacgaagaagaagacgcaacgcaggagctcgtcgaggcagctgggctgtcatggtggacgttcaaccatgaacgctcgagctgggttgttggtggatggagatggacatgggcgtgaaggaaaagaagtgaagaagaagaaggtgaagcagcaagtatggctatggagctcgagggtgcgatgaaaaaaaagaagaggcagcagccattaaagctctaactcgagctcgaagaaaatggcaacgacgaactcgacggggcagccatgggcgaaaagaagtgttgtcggatgatggtggagcttgacatggctgtgtagctatgcgaagaagaagaagcagccatggttgtgtgtgtgtgtgtgtggtcgtgagggggaagaagaaggtgaaggtaaggggaggtggcggatggtattttcaacagtgaaaattttttagggttttgtttttgaaatgaaagatagggaaatggggtgttgggtctttggggttatggactgggtcgacccggtttggaatggaccaggtcgtagaggaaggttgggtatatttgggtctgtggttcaaaattgaagaaaatgcctaattccgattttcttttatattttttgctctcttttcttttacttcctaattaataaaactaaaattctaaattaacttataaactaaattaacttataaaaaatactaattaatttcaaataactattatcgcacatttaaatagcaattaacgataaaattgcacaatttagacgttaaatgctaaaaatgcaacgtacattattttttatgattttctcatttttgtaaaacaaacttaaataaatactaaatgaaaatgcgacatattttatatttttattaatttaaagaaataaacatgcacagacaaaaatacaaataattatataaaaataccacaaaaatacaaacattgcacacaaaggaaaattgttttattttgaatttttgggagtgattctcatatagggcgaaaatcacgttctcacagcggcccctctttgtccgaaaacacgaagggttttcgtgcaaagataaagtgagcggatacgagtgatttttgcccgttcgagtactccgtgtgtagcattttttgaaagatttgaccgaacctttgcttcagaggtttcctacatatcctgggctaaacaggaatcgggtcaatgtagttcgggaagttttggtagctgggactaccatgggactgcaatgttactgctgctacatgatgttgctactgcttttcgatctccttattacaccgtgccaaaagaaaataagaagctagactaagctaggaattacaaaatcttatctgtcttccccttgctctggttgccttgctttcttgttggcttgtgtttcctctggtgcctttctttcgaaaactgctggggatgacactggccttttgccttttttaacataagttttattattccgttctgtctgctggggacactgcttcctacattaaagcttgttatgctggggatctttgttgtactccccctcattactgacttctgtttgatcttgaaatgtactcctctgttctgcaggcgggctcctgacttcaacaacttcctcaaaattttaacacctccattctccaggcgggttccttacttcttcaacttaaaatataacgacctctgttctacaggcgggctcctaacttcaataacttcttaaattttaacaccttcattctccaggcgggctcctgacttcttcaacttcttaatttttaacacctccattctccaggcgggctcctgtcttcaacaacaacttaaaataatttagcctccattctccaggcgggctcctaacttctccaaatttcaaaataattcagcctccattctccaggcgggctcctgacttcaacaactttctcaaaataattcagcctccattcttcaggcgggatcctgacttcaacaacttaaaaatataacgacctccgttctataggcgggctcctgacttcaataatttcttaaattttaacacctacattctccatgagggctcctgacttcttcaacttcttaaattttaacacctccattctccaggcgggctcctgtcttcaacaacaacttaaaataatttagcctccattctccaggagggctcctgacttctccaactttcaaaataattcagcctccattctccaggcgggctcctgacttcaccagctttctcaaaataattcagccttcattcttcaggcgggctcctgatttcaacaactttctcaaaataattcagcctccattctccaggcgggctcctgacttctccaactttcaaaataattcagcctccattctctaggcgggctcctgacttcaacaactttctcaaaataattcagcctccattctccaggcgggctcctgacttcaacaactgcttccttcaaaactggtgttttattcctctgaaaattgttggggataacaccgatattttatttcaccaatatgtcatgttccttcttcaaagactatttcctttaaagctggtgctttcgcttccctgaaacctgccgggaataacactgctggggaattatcttcctccttttaacaatggtgggaatgatattgattccaaggccattgcttttacaactttgggttatcatgcttcttccaagattgcttttcttttaaaacttgtacctcccttcttgtatactgctggggattttattttctttaaaatttgtgttatcttctctctttcccaaatggctatctgattttaagaaaattttcgtaattagagaaaattttctgccccagtttaataatcctctttgtgaccctgtcttcctgtggtcaataatatttcctttccctgctttaaatcaaagaaatatttgttagtttaaaacgtggtgagtgatcgtgccacttctgctggagatggtttttccctttttattttccctgcttttctacaaaacttgttggggatgatattcctactggggatggttttttcttttctcttccttccccgctctgtgttgtccgtctattgtggaacctggtcgagaatttgttgcagttgttcctgtatcttgtaaatctattggggatcctcttggaatttgatccataacttcccttggaaatttgggcctcttaggatctagacccattcatcatttggtcttgcgacaaacttcttttcgctttgtcgccttatctttggcttgtccttttcgcattttgccttgcaccattttggcaactggtagtaagctctgaaaatccttttcaaaaataaactgttggggaaataaaatcttttaaaccaagaaatgaaagagtgataattttaaagatagaaaaagaagtctttctgaacaaaccctggggaaaaagaaaagaaaagaacttatctgaatgatataaccaatcccaacgatcatgtcgtgcattccggattgatcaacccagtctatttgtatcaatccatctttcggatggcctcatctcgctggggataaataaatactcaacttttgccaaatgtggaccttttccgccaatctcgccttgtcgcctcatagtgcccttcgaggggttttcactaataagactctctcattttattttatttttcagctggggattggagcgttgtcgatatgacgctctttgttggggattatttcgactatcaattcatttccagtttatgatcctcttctctgctggggatcagagtgttgttccccacttccatgtgcatgaacttggcacttctcggttactgatcgggaggtcttttttggacatcaatatggtttttttgtgtatggctaaaaggaaaaggggtatcaaaagtttaaaataatttggaggggtaaaacagtacaactcttggaatcaaacttttttttcaccacttctgccccagttcttcttacttggggatttttattttttggttacactatgaccgagccgtgaggcgcctacgtatccttctttgaggaatcaggtcaaatgtagttcccacttcctttgtttttcttatgatttttcttttgtctttattattgtttttctcttttttttctttttttttttattaactccaaaagagggatatgaaagaataaataaggctcaaaagggtaagcaaaggttaaagtgtttggatagaagaaagaattgcctccgtcatttcattctccgataaatgccaaccacaaacaaatgacaattacaaccaaaagagatcatacataatatctcttaactgcgtcggaattgatagccatgtcgacacatttcccttcgatatctgttaaacataaagaaccatcggacaacactctggtaacaatgaatggtccttgccaatttggggcgaacttgccctttgcttctgcttagtgtggcaggattcgtttcaatacttgttgccccacttcaaattttctggggcgcaccctcttgttgtaggctctttccattctcctttgatataactgtccatgacacacagctgccaatctcttttcatcaatcaagctcaactgctccaaacgggttctgacccattcgccatcatcaatctcagcctcagcgacaatccgaagggatggaatttcaatttccgtcggtattactgcttcagttccatataccaacaaataaggggttgcacctactgaagtctggacggtagtgcgataacccaacaacgcaaatggtaatttgtcatgccattgcctggatccttctaccatcttcctcagtatcttcttgatgttcttgttggctgcttcaacaaatccattctccttgggacaatatggtgtggagttacggtgtacaatcttaaactgttcacatacttctctcatcaaattgtggttaagattagcaccattgtccgtgattatcactttcgggatcccaaatctacaaatgatatgggaatggacaaaatccaccactgccttctttgttactgacttgaaagttttggcttcaacccacttagtgaaataatcaatggttaccagaatgaacctgtgaccgttcgaagtcgtcggctcaataggcccaatgacatccatgccccatgccacagatggccatggtgctgatattgtgtgcaattccgttggtggagaatgactcagatctccatgtatctgacactgatggcattttcatacgaaactgatacaatcatgctccatagtgagccaataatatcctgctcgaagaatcttcttcgctaatacatatccgctcatatgtggcccacaaactccagcatgtacctctgtcataactgtcgtggcttgactggcatctatacatctcagcaatcccaaatctggggttcttttgtataacactcctccactgaggaagaaaccatttgacaatcgccgaatggctcttttctgatctccggtgacctgctccgggtgtatccccatcctgaggtactctttgacgtcataaaaccatggctcaccatccacctcttcctctatcatgttgcaataggcatgctgatcacgaacctggatgtgcaacgggtcaacatgaattttgtctaggtggtgaaacattgatgctaaagtggccaatgtatcggcaacctcattgtgaactcttgggatgtgtctgaactccactgatcgaaatcgcttgctcagatcgtgcaaacattgtcgatatggtatgagcttcaaatctcatatttcccattcactttgaatttgatgcaccaggaggtctgagtcccccaagaccaagacgtcctggacatccatgtctgcagctaatcgcaaacccaaaatgcatgcttcatactcagccatgttgttggtacaatagaaacgcagttgagctgtaacaggataatgacgtcctgtttcagaaataagcactgctcctattccaactcccttcgcattttcggctccatcaaagaaaagcttccaaccgggttcctcaggtaactccaactcatctatatgcattacttcctcgtcaggaaaatacgtcctcaacggctcatattcttcatcaacaggattctcagccaagtgatctgccaacacttgggccttcatggctgtcctcgtcacatagacgatgtcaaactccgtgagtaatatttgccattttgctaaccttcctgtgggcataggtttttggaaaatatactttaatggatccaaacgggaaatgagataggtagtatatgaggataaataatgtttcaatttttgggccacccaggttagggcgcaacatgtcttctcgagttgagtgtacttaacctcatatactgtaaacctcttgctgagataatagatggcttgctcttttcttcctgtaatgtcgtgttcccccaacatgcagccaaacgaattctccaagaccgttagataaagaattaacgatcttcccggctcatggggaaaccaatacaggtggatttgataaatattctttgatctgttcgaatgcctcctggcattccgccgtccatcctaccgcggcatccttcttcaacagtcgaaaaatgggttcacaggttgctgtgagttgagcaataaatctgctgatgtaattcaaccttcccaacagactcattacttctgtcttgttcttcggcggtggcaaatcttggatagatttgatctttgacggatctagttcaatacctcaccgactgacgatgaatcccaaaagcttcccagatgtaacaccaaatgcacatttggccgggttgagcttaatatcataccttcgaagtctttgaaagaacttccttaggtctgctacgtggtcttcctgatgcttggactttatgatcacatcttctacgtatacctcaatttctttgtggataatgtcatgaaacacagtggtcattgctctcatgtacgtcgccccagcattctttaaaccaaatggcattacctggtagcaataagttccccacggcgtaatgaaggctgtcttttctgcatcttcctcatccatcagaatctgatgatacccagcatagcaatccacaaaagatccgatctcacatccggcacaattgtcgatcaagatatggatgttgggtaaaggaaagttgtctttagggcttgtcgacacacacccttatctttccatctttctttggtaccagcaccatattagccaaccaatcaggatatcgagtgacatgaataacctttgcttgcagctgcttggttacttcttatttaatcttcacactcatatccgttttgaacttcctcaatttttgcttgacgggagggcatgccgggtcagtgggcaatttatgaaccactaaatctgtgcttaaccccggcatgtcatcatacgaccatgcaaaaatatctttgaactcaataagtgttttgatcaattcctccctgatatttggtgcaatgtggatgcttattttagtttctctgatatcgccgacatcccctaaattgatggtttctgtgtcatttaagttgggtttgtatttttcttcaaactagcttaactccctgtttatctctttgaatgcttcatcctcatcgtatttcgattcattatcataatcgacctcttgtatggttagctcggaatcagattgatcttttagactaggttgaagatccgttgtgcatgccatgtcattagaaccagtatgaaaagaacttttcagaaaaagaaacgaaagaaacaaaattaaaaataataacttataaaataaaaaataaaaaataaaaataaagaagaaacttttcattttattgaattatgggataacaaggtttcacactatattgaacacaataagaaggaatctggattacaaccctggaataatccagaaaacaaacaaggaaaatcagagccaactaccaggactccctccaagtaggaagaggagtagctatctaattgttgaccttgaccttaggacccacaaactgtatgtctgccttactggaaccctctccagcttctatcatgttgatatcggtgccacacctcctttttctgttacaatcggcaaacactctttcaaagctttcattcaaatctccatctggccccatcagaggtccaagaactttcgggaccgacaactttctgaaccctgctttgacaaatgatctggacaggcatgggactggcttagaaaggacccagactcttttcttcaatttgcgggcccatttcacatccgctgctataggcttgaatcctaacccaaacgtttccaggttcttgggcaaagaaactagctggatcattccctgcagatcaacccccagaccttttcctggtacaaacccattattcaacatttctgatgctatcatgaaggttgcagctgtgattctgggaagtggaaggcccccgtcctcaggaattttgtctactgagactgcgtcgaaaatctgataaacccatgggcccttatcatcgtcggtttctatgaagggcacaatagcatcgctgacggcatgtgtgccgtcatccccgtgtaccacaatctcttgtctatcccattcaaacttgaccatttaatgcagtgtagaaggcactgctttggctgcatggatccagggtcatcccaacaaaagaatgtataacaccgccacatctattacttgaaattccatggtgaactcgaccggaccaatggttaattccagtacgatatcacccactgtgtcagtgatgcccccatcaaaacctcggacgcagacactgttcttgtggatcctatcatccacaacctttagtttgttcagagtggccaaagggcagatattggcacttgacccattatcaattagtgctcgagtgaccaccgattcttcgcattttaccgtaagatagagtgctctgttgtgttcagtaccctctatagataactcatcgtcagagaatgtcactcggtttacttcaaagatcttgtgcgctactttctccaaatggttcactgagagcttgtccgggacataggcctcgttcagaatcttcattaaggcctgacaatgatcatttgaatggattaacaaggatagcaacgaaatctaggctagggtctttctcaattgctctataattgagtaatcctgtgccttcatcttcttcaaaaattcctctgcttcttcgtctgttactagtttctttattgtttcaggattgacccttctcaactctgcgggagcaaaacaccttccctatcgagttaacccctgtgcctcgcatacgtcttccacaacctccttccccttatgcgtcactgtcacttgactgtagctccacggcacagctttctcacttgttatcggcaactgtataaccggcttgataacaactggttccacatggaccccttttactaccaacattggtttgtttgctactccttgcaacactgctctgactgactctggcttcttcgcagcaacagacgatcctttccctgctaccacaaatggcttgtcatatacctttcccgactgtaccactgcctttccactggttgactcttcattaaaactggcgcgaatcatcattaccatttgtgagggtgtttttggtttccctccttcgtgcactagttcgatcatgtgggcttcatggtgcaccggtaacggatttttattgatgttgggtgcctcaggtgcctgaacctcgatcctatttgtgtcaataagatcttgtatggcagtcttcaacttccaacatttctcagtatcatgctcgggagcacccgaacaatattcgcagcttactgaatggtccagatttctgggaaggggatttggtaatttggtttcaacaggacttagtaggcctatttgcttcaacttgtgaaacagagtagtataggtttctcccaacggagtgaatgctcttggcttctgcatcctttcgttcctgaaagcctgatttccgcggaagcttggccctgaaggattcttgtaggccctcggtggtggatatgtgttttgtggaggtggatatatgttttgtggaggtggatatgtgttttgtggaggtagatatgtatgttggggagccggttcacgccattgcggacgagccggaggctgggtgtaagtttgggcgtgatggacggaaaaatgttgttcttgtggtggatagtagggttgtggagggtaatttggaatgtgtgagtagtttagatgatggggtttgggttggtaatgagggtaaggacctctagatctggaccaattgtctgcctctattgtcgtgacctcttctctccttttctttccgagcgcacctcccgtgccgctctgaatggcctaagttgttgccttaattgccgagtaacttatgatcttattggacttaagtccctcttctatcatacctcccattttcaccacttcattgaaggatttgccaactgacgtcaccaagtgaccgaagtaagtcggctctagagtttgtagaaagtaatctaccatttctccctatctcattggaggatcaactctagctgccttttctctccatcggaatccaaattcccggaagctctatccgggtttcttttcaagttttagcaatgtgagacggtctgggactatctcaaggttgtattggaagtgtcctgcgaaagcctatgccagatcatcccaggtgtaccacctgctcggatcttgtcttgtataccactctagtgccgacccgctcaaactctggccaaagtaagctatcagtagctcatctttgccccccgctcccctcattttgctacaaaatccccgtagatgtgccataggatcgccatgcccttcatataaatcgaatttgggcatcttgaaccctgctggtaattggacgtcaggtaaagggcatagatccttgtaagccacgctgacctggttgcctaacccgtgcatgttcctgaaggactgctccaggcttttaaatttccgcatcacctcgtcctgctctgggctcttagacggcttttcaatctccgtcgggacctcaaagtggggattataggtatgtggctcgggtgctttgaatgtgagttcaggggggtaatattgtgtatcgtgagcctaaaacaaaggctcgctagacaatctatgcaatggggctggggcaggcgccacaaagacgggaacatttggtggaggaggattctgattgggtggtagagcttggggatcataggcctctcttccctgatagtagtgatggcttgggaaactcgttgaaggaccgggagaggggtattctgacgtgtgtcctggttggagagtaggagtaacaggtagttcctgccccttttgggctctagctaaggctatctgcatttcattcatttccagcctcatcttttccattttttccatggcttccttcagcatctgatttgtcgtcttttccgaatcaacaccattgtctgaaccagtcatgctttctggtatgggcccttttgatcttgtttgataatggtacggtgccagtacgctttaacaaactaattggtattgattggaaaaacaacaaacttgccagtgttagagttagagtcttaacagatattgtatttgcacgttggggggatgcaatgttcttaggcagttaatcatttctaacatgcttttgctccgaccgcatgcatcatcccggcttattttatttgtgcctttttcgagtgtttcagggacctttctttttttcttctctctctctttttcctttttttaattaccgtcgaatcctatagagagtgcctacgtatcgtgactccgcatgaatcagaccaagcgtagttcgtgcatccgtaaaataaagacccaattttacattttattacccaaatttgctcttacaaactgttatttgaaagaaaacaaacaaaatacagattccacactattaataatgtttgaagagaacataggggtagacaacagactctaaaaaaacaaacaagtgcagacttgaactagggatacattaaagccttgaattttggttcccgcgaggcatcgttcggcctttccgcgggctttggtgtaagatccctttgtaagcttttcaactcatccatgatccggtggacgtagcccatgatggaggcaagaagggtatcccgaggtatttgctcacatgctaggcatctcatgtagatgtagtgcccaatctcatcaatcctacctcggatgttatccctttcccctaacagttgctctattcgtcggttctttagtcccagtacttgagcattgtcggcgagtcgatcctgaaacctctccatttgttcttccattctgtccatcacatcataacaatgccttctgtctgcttgggcatctcggatttgtttaaagatcctctactgaagagtggagtttgtttctcttaatagtccaatgcttatttcagaatcccttatgacttgttgtagatgttttctccgtgtcattgtaccttttgcccatctgaaccgcattctcgctatgcaagcctcggatctctccaaatcctctcggcttttgctgacctgtctcctcaactctactatcaacctctcattggaccgacttttctgttggtcaccggtattctttctgtcttggcggattcgggctctcagggccttattctcttgaatcaacttgcttttctctcctgtatcagcatcaatttgcaagctgctttggtattttagcccctcaattgttgttttaacttgccaatctcgacccgatattccttctcttttgctagccaaccccattgtgctcgcgatgattctacaaagtcttggacgtgagctcttttagttggtctctggtgctcaagctctcttctgtaccatgtgaggtattttggcgacacttcgcctttggcccggtcttgtacacgagtatctactttcagggtttgacattcattccagattctccgaatgactgcttcagggaactgcccaccaggcccgatttcgactacctggccactgagatcctcttcctttgggactatttggtatcgccccaactgtctcaacactctgtatagtgcgtagggctggatactttggagacccatcaacaacaaatgagattcggcggctgacatgtttatgatttcatctatgggtagccacctcaatgcccattctatctggtttgctgagatggaacgcaacagagtgacccattcggcgaccccttctggcaggctaaacccgttgacccttgtggaaaactcttctatacaagtcttttgtgactcctcatattttagaaactgagggcgatgacataggtgttctatcatccacatttacagtagtacattgcaaccctcaaagaaacctcctccggttttgcaaacagtgagagcgcgaaagatgtctgctattatcattggtgccagagtgctgttgttttgcttgagcaaagtgctgacgaccccagcgacttgtatgttaattttcgcgtcttttctcgggaataccagaaggcccagaaaggctaccatgaaagcaatacacctatgtctttcccatttcagctggttttccccgctgcagatctttccctcgggattgttgaaccctccaaaatgaccgtatctgtcgtacaggaatgccaaactacaaaaaccttcagataattctgggttgtgtataactctgcagatcttcacagtgtctaaaaatctgtgtatggtcacggtccttggtgcaataagatactgctctctcatagggactttgggactcccgatgtaccctgccagttcttccagtgtcggtgtgagctcaaagtctgagaaatgaaatacattgtgtgttgggtcccagaatgaaattagcgcccttataatgtcccctctcggaacaatgtccagtaacccaactaagtttcctaagtacatcttgactgtatctcgccctgattcttctaagtcgttccaccacatgcgtaagtccaaagggatcccatttacaatggcctcagatgaattcctaatcgtgctcattctgcacatttattaaggggatttagacaaaaagcaaaatctttatttgactcataaactaattttcctatttttttcctaatttttttaggaaaagaaaaactgattcttcaaatacggccttttgactcttcagggatgaagattttaaggctgtagggatttaaccagccgaaaggtaaaagaatgaccaaaggtgcttatgcaaagtcagccttccagcgcccctttagggaatgttcggctatttttgcaacatggcatcgcctgactcttttataaaagtggcaacattttgtcattttttcttttctggttgtttttgcaaaatggaaagttggacccgatgagggttgtctacgtatctcacaccctgtgagaatcaaaccggcgtagttcgggtgatcatgaataaagtaaatagactaactttttttttcattattattatttattattttatttttttgaaagaaaaacttataaagaagaaaaagagaatttttgcaaagaaggatttctaaagaaaaaaaaattgaattttgaaagaaaaacttctaaagaagaaagaaaatattttatttttttttggaattttacttttaatttatgaaagaaatgcttccaaaaattatttttttgaattttgaattttcttttcaattttttgaaagaagaataaaaatatatatcttttatttgattttttttggaagaaattaaaagaaaatatttttattttattttttatatttaaaaaaaacaattaaaaagactttctaaagaaatcaatagtggaaaatatttttgtatttttttttgaaaattgggggcttaaaaaaaacttttctagaaaggaaataaagaaaaatattttttggatttatatatatatatatatatatatatatatatatatatatatatatatatatatatatatttgcaacaaataataaaaccacattcaccgcccgactctttttatttttattttttggcatttttgtagacaaataaataaataaaaaaatattttaaaaacaagactttttttttatttttcatggcaatacaaactattgtttttttctctttctaaaataggcaattaattctctacactgttacttcgctttttttttctccaaaattttccaatattcctgattttccaaagccggtcagcatgcaagtctaaagcaaataaatgcataaagcaaataggatgcagcaggatggtcttttcatttcaggttgctagtcctagacggacccaacccctgtgttgagtcccttaagtcaaatgcaatatgatgcagataagcgttcctactagggattcggcatgaagctgagttattctaggtttataatctaggtatttgttctagactgtgtacccgagtggacaactagagtcgaggaggggctacgtaccggggacccgcgagatcgtccggctttgtaacttgtccggcctctttcttatttcaggtattgacactaacagaatagggagtctcgaccagcgagcttctccccgaagatgagaagagaagggtttcggcacagtttatatacagttcagataatatcaaagcgataaaagcaacattttgcggatttaagccaaaacatgtaataaaatcaaataataaataaagccaaataataactattattctaagctcgaattcttgaaccctgaaccagagattctgggtcaagtccccagcagagtcgccagagctgtcacacctcctttttccgcctcgcgaggggtgaaggagttttttccaattaaaggacaatcgaaacgggatttgtttatttatttcagagtcgccactggggagatctatggtgtcccaagtcaccggttgaatcccgaatcgaggaaagaatgactctgtttaacagtccgtgaatcagaaatccggataaaggagttctgttaacccgagagaaggtgttagacattcccggattccgtggttctagcacggtcactcaactattatatttggcttatttatctgattttttttaacaattaaggacttatatgcaaatttaactttgacccgcttttatcattattgttattattattattttatacaagaattgcaacgtcgtgaaaacgcatctcgaatcacgtcacaaccagtgtacacgtgatttgttgacacattttgactccgccaagattgggatttgagttacataaatgcacactcatatttaagaaaatacctttattaaatacacgcctaaagactacggttatactttgtattgtttatatttgtttacttttttttagcgaaatcctcccttattttatgaatatcttaaaatgactatattttttattattaagtttgtctataaatataaaatcaatctttacatacttaaaaataacatattaaataccagtttaaaacaaatattaacgaaaaggaatattactaaaattgtaattataaatacaatatggaattgtcaaatatttttttttaaaaaaaaaactaattatcccataaccggattaaaatcatattgttagatgacttgagctattgaaattaattatttacaactactgaaaattagaaacaatcttgattactattgcgtatttctaaaatttaattaatttaaccttaactaaccttgttttaattcaaatcatgtcctaatacttgattcgcaaaattaatttaaactcatgttttaactaaatttagctacatgatttcgattaacttaatgttggtgatactaaaacccatatgaatagtgaaattaattaattttgccaaacagatttaataaagtcatttttacgttattttcttctcattctaattattagacagtttaatcagtaatgaacatgcttaaatatatactacctaataatcaggttaaagaaaagcattatttaatacatcgctacaatatgtctagttatgcaaaacgacggtgatttacagaatagtaatacatgaaataacctaaatacaaaaaaaaaagctaaattagaaatttaaaatcccattcttcatttcaacttacaaaatgccaagattacagttgtgtacctggtattgccaatataagaagaagaaagtcagcaatgtagtatgtaacacaacaacaacaataataaccagcaatccagtcaacagaaaatctcagtgacagatttgaaaatcaagataaaaatccagaaacaccgacaacaaacaacggacagaagccaagggaatcttttcagatttgaaagactaattaatatttaacccttaatttctgaacccgtatatcagaatatttatcaggtgtatactactctctcttttaatttccagccctttttttattttgtatatttttttttcttttttgaaagtcttaatatttttcggaatttttctttctctctcttcaatcttcagccctctttttttctctgtctccttctttataatctgatcaagtccccctatttatccccatctttcaacattttttaaacataaaacccactatcttcccactcatcccccttttaatcccactacttaatgttttgtcccccactacattaaacaaataccccattatatcttgtccccgtgcttatattaaacaattgcattattccccaccattatatcttgtccccccattattgattattttaatattattttaatcctaattgatagagcactcaaaataaataattgttcataattttaattccaaaaatacccctctaaccttactgaaattaacattttacccctgaacgtactgcaaattaccaaactacccccatcagctataaccaattcacctaatcaatttcaaccaaaatacagcaaatatgaccaatttctatacaattttcaacaacaaattcaaactaaatgatgaacaaccaagaaacaactaaaattattttgattgaacaatattttttaacaacaaacaaacctactttcagattcaacaacaacaacaacaaacaagtatattcagatttctatattcaataatcatttgaacttaaaattaaatctaacaacattacaaccaacaatttctatattatactaatcaaaatcatgaaacaaactgaagaaataatcataaatgataaacaacaaacaagaaaatcaaacttatgctaatttcggattcaagaacaatcaaacaaagtatggacataaatgaaaagattcaacaacaataacaagcaagttttattcaaattcgaattaaactcgaattaagcttaaacaaaacaaataaacatattcaaatcactaaacttcaaataatcaattgatctttttaaattaaatccaacaaaattataacaaagatacattgaatcaaaaaattaaaaaccaaaacataacttcacattaaatcactgaattaaaaacgaacttcaaacaaatgaacacgaattaaatctatattaaacaacaaacatgacggattcaaattatttaaactaacacttttctatattaaaactaaatccttttaaattaataaaacaaactgaagaaataattaattgaacttcaacttaaatctaaaaacattataattaaactaacaatttctatctaaaaataaataagaaaaatgaaacaactgaataaaaatcaagaacaagaatcaaacatttaatgatttcagattcaaaaaatatcaaaaaaattacggacaaaatgaaactcaaaccaactaaccggatcggaacgacgaagaacttgaatgaaaacaaatccgtccggaagtgattatcgcaccaaaacaattcgacgccgaagacgaccccgaacggaccatcgaagaacttgaagaaggaagcagcggacaacagcagcagtgaaggatgaagaagacgcagctacagctcgtcgaggcagcagtagcgacgaagaagaagacgcaacgcaggagctcgtcgaggcagctgggctgtcatggtggacgttcagccatgaacgctcgagctgggttgttggtggatggatatggacatgggcatgaaggaaaagaagtgaagaagaagaagaaggtgaagcagcaaggatggctatggagctcgagggtgcgctgaaaaagaagaagaggcagcatccattaaagctctaactcgagctcgaagaaaatggcgacgacgaactcgacggggcagccatgggcgaaaagaagtgttgtcggatgatggtggagcttgacatggctatgtagctatgcgaagaagaagaagaagcacccatggttgtgtgtgtgtgtgtgtggtcgtgatggggaagaagaaggtgaaggtaaggggaggtggcggatggtattttcaacagtgaaaattttttagggttttgtttttgaaatgaaagatagggaaatggggtgttgggtctttggggttatggactgggtcgacccggtttggaatggaccgggtcgtagaggaaggttgggtatatttgggcctgtggttcaaaattgaagaagaggcctaattccgattttcttttatattttttgctctcttttcttttacttcctaattaataaaactaaaattctaaattaacttataaactaaattaacttataaaaaatactaattaattccaaataactattatcgcacatttaaatagcaattaaaaataaaattgcacaatttagacgttaaatgctaaaaatgcaacgtacattattttttatgattttctcatttttgtaaaacaaacttaaataaatactaaatgaaaatgcgacatattttatatttttattaatttaaacaaataaacatgcacagacaaaaatacaaataattatacaaaaatatcacaaaaatacaaacattgcacacaaaggaaaattgttttattttgaatttttgggagtgattatcatatagggcgaaaatcacgtgctcacagggatgatgatgtttcttgtgatgttgttccattgcggggacttgattgttgaactattattcccttgccgggattcttattgtaatttcatttactcccttgccctattatttgtgattgttgtttgggtgatgaagagtgttaaagtacgaagggtgatgacgtctattgtttggtgagagagtgttaaagcacgaagggtgatgtcgtgcatgatttgtaaggaaagagtgtaaaacacgaaaggtgatgtcgtgccgcacaatgtaccattccgtgcctattatattgattatatggtgaggacgagagtaaaagcatgaagggtgatgttgtgcacattttcattacttgattgctttggttaggacgagagtaaaaggacgaagggtgatgtcgtgcacttattgattcatgattctttgttgatatctgagatatgttgtttcttttaattgcccgttgtctttctattctaaattgatagttcctcgcaacatgttacccctctcatacttgactatatattactgttttttttccgttgtatatagttaaatggcacaggtttatttggtagtctggtcctagcctcgtcactacttcgccgagattacgctaggcacttaccagcacatggggtcggttgtgttgatactacactctgcactgtgtgcagatctcggagcagcagcttttggaccgtagattgggtggctgccttcagtccacacggagatccaaggtagtcctgcaggcgtccgcaggcccttgcgtctctctctatctctttactcttatttcatttacttagttcagaaacagtgtatcttttatttttcagactttgtatgtagttttcttagatcgtctgtgaaactgtgacaccagttctgggtggtcgaggctcaaacagttgtattagatacatatttcggatagtttactgcatttcttccgcttattgtaattttcgctgtctacacgttattgcttttataattgttaaagaatataaattggtaaaaaagtaatttgttcaaacagtcgacttgcctagctcacattagtaggcaccatcacgactctcgaggatggaaaatccgggtcgtgacagaattccaattttatcagcccttcatccttcctctctccatatcagtggcccatctctctctctcaaagttcttcaaataagaaaagataagggaaacagaaaagtaagatggacattaagggtgtgtttggtacgaaggaaattgttttccatgaaaaatattttctcatgaaaaataagtagttttttcacttatttttccttgtttggttagtgagtggaaaactttttccgaaaaatattttctagtatttggttagagaatagaaaatatttttttatgctactctccttcctcccccaagtcccaatgtttccttgctccacacccccccccccccccctcccctcaagagccaacattttcaggactctattttcttcgaaaatttcattattcttctaaatatttacacaaacccaaaagaactaatgtgttgctttacttttttttactcaaaaataacgttgaaatttgtgcttcataaccaaaaaaaaatactcatttttttggttgaaaaagaaagtactctttctacagcatgaaaagaaagtattcattttattgaaatgaaaaaaaaatactttttctacatcatataaagaaaatactcattttgttgaaataaaaaaaatactttttttatatcatgaaaaaaaatattttttttgttgaaatgaaagaaaatactttttttacatgaaaagaaagtaattgttttgttaaaatgaaaaaaatactttttatatcatgaaaaaaatactcatttgttgaaatattttttttttatctataacatgaaaagaaagtactattagtaatatttttatttagggtgagggtgagggtggagtgggatggggttgggttggggttgggttggtgggggttgatgaggatgggaaataaggtggagaaggttgagaaggagttttgaaaagtgttttctctttctcttgataaggaaaacattttcctccaaaccaaacacaccctaaacctatatttcaataatttcttgtgccaagagagaaaatctatatactttaagattatgttgattcctagtactcgctcgcaccagcatctttgtatattgtcattagggtaaaagtactccaaatttatccctaaattttatgaaattaatcattcatgctaatttgttaaatgttttcttttaaaactgaccttctcgttatcaaactattatatgactagcatattttattaaagatacagcctactgccttaactaattgatttaaaaaatttaaattgacacaaaaataacacccttactagttataaaaataatgatggagatattaccagcacatactgctactcctactattaataataatggtaataaaaagatggagatattaaaagcacatattactactattactaatattcctactactattaatatatatatatatatatatatatatatatatatatatatatataaattatgggatgtttcttgaaattaaccacctttcaacaaattcgaaatcccaaatctatcagtcattcatccttcctctccccctattcagtgacccatctctctctctcagagttcttcaaataagaaaagataagggaagcaggaaagtaagatggacattaaatcctatatttcgtgaatttctggtgccatgagagtacacggtcgaaattgggtacgcctattgtgtgaccaatcgagactgaaacatggcaggccaaagctcgagctcgggttatatcaaatcaaggcgcggaattagatcgtcgagctcgcgaccccgaaacggaacaagatcgagaccgaacaagatcgagaaaaacttgccgagccaaataacggaaggccgaaatatccgcgatcgattggagatcatggcggaaatctcagcacgtatcaagaaaaggccaattaattagcaaatcatgagatttttttaccctgtatagaactgtatcaagagtaggacacccctactatataaaagaggttttgatcatttgtaaaggacatgttaaaacacatcaaaaggcaatacacgattatttctagtcatcttgttgttctggtctaatatcagttgaggcattttttggctcgggggtgatcaaactcaaaggctaaggttgttcaatttgtgtgatttgcacttatatccttatcagtaatttcaatattaatatgttttcttaatttgtatcaagttacatcacgtatccttaaaaccgcgtataaatccaattgttatccgattttgagggtaaacagtttggcgctcaccttggggctaaggataatagtggttacttagtacacactttcataacacacactattttatacgtattctttggagtatctttgattccaggaccaaaatgttgaactctccgtcagtacccctacacattgacaatgatttcggccaccacggcgaaaataataacatagcaccaggaaacgacgtacccccgatcgatctcgacggagtccctgctgtggatccaatcgatgttaactcatatataacaatcaatgcaaattcggctgttgatcccaaggaagtgttcgtagggatgttcgatctgccgctcaaagaacacatggcgacgaagatgtcggaatcaacttgcgggtgatttttgaaatgttgcaggctcaacaagcaacgatagcctagctctagaaccagaatcgcccgccgagtaggattgagcctagccgtcctagaaagttgttcacagagttgaatcgatctcaagggaatcgaatgataaagaaccgaggaccaatcctataatcatgaagatgctcgaggaaactgacaaaacgaattgagtcggggggaaaagatgattgaggcaaacaataagaaggtggaaacttaaaactccagggtcgaccgaatctcgcgagcaacactgatattgaagggcctggattcaaaaacgttcgtgcaaaaaccttttcccccaagcgtagctctcaagccgatccccaagaaattctgcacgcccgagattcctaagtacaatggaacgatcgatccgaacgagcatgtcaccttttagacatgtgctatcaaagggaatgatctagaggatgacgagattgaatatgtcttgctaaagaaatttagggagaccttgtcaaaaggagctatgatatggtaccacaatttaccacctaactctattgactcatttgctaaatgcttgcagattctttcgtaaaggcacacgccgaggccatcaaggttgagaccaggaagtctaaccttttcaaggtaaggcagaaggataacgaaatgcttagagaattcgtatcttgattccaaatggaacggatagacctgccaccagtcgttgatgattgggttgttcaagctttcacccaaggactcaatgttcgaagctcggtggctttgcagcagttgaagcagaatctgatagaatactcggctgtcacttgggccgatgtgcataattggtaacaatcaaagatcagggtctaagacggtcaacttgggctcctttcgggtccgtttatcttgttagacccgtcgatagaatcaagaggaatatcgaccaagaaccgaggttgaatagagatcaataccatccatataatggagatcatagaagtaacgggtctgggagaaattctatgtgaaataaaaggagaagtgatcgaggccagagctctcgagggctcatgggcaagaacggcttcaataggcctatcggacctaaagaagcaccacaattattagaatacaactttaatgttgatgcaacttccattgtatcggctattggacgtatcaaagataccaaatggcctcgacctttacaaaccgatcaagcccaaagagatcccaatcaaatgtgaaaatgtcatggcactcatggctacagaatgaggattgtcaacaattgagagaagaagtagcctggttattcaacaacgggcacctttgaaaatttctgagtgaccgagccaagaatcatttcagaaacaaagactgtaataaacaagccaagcaagaataaccttagcacgtcatccatatgatcatcggatggatcgatgttcctcaaggtccaatgttaaaacgcaccaaagtatctatcacgagggagaaacaaacttgagaatacataccagaaggaactctgtctttcaatgacgaggatatagaaggaatcgtgcaaccctataatgatgcactagtaatatctgtactcatgaataaatctcgagctaaacatgtgttaattgatccaggtagctcatccaacatcattcgatcgagggtcgtagaacaacatgccctataggaccaaatcatacctgcagcccgaatgctaaacggattcaacatggcttgcgaaactactaagggagaaataacgctaccggtaaacgcatctggaaccatccaagagaccaagttttatgtgatcaaaggggacatgaggtacaatgcccttttcgagagaccatggatccacaacataagggtgtgccctggacccttcaccaggtgttacaattctcaacaccagaagggattaaaatgatctatggggagcaacccaccgcaaaggagatgtttgccatcgatgaagtaattccgatatcaacactctcattgataaaggagccaagttcaaaagcaaacagaaagccaaatagcaatcaccgatgttggcctcgacccaattgaacaagaagaagattgacgaagatgatgattacggggttcctcgatcctttatagtccccgatgattctgacgctaccaaatcaatgatcgaagagctggagcaggtcatgctgatcgaacaccagcccgattggaaggtaaacctgggcatggggttaactcccaagctgaggaaaaaactcattcaatttcttatagctaacatggattattttgcttggtccaatctcgacatgacagggatcccatcgtagatcactactcacaagctaatcctggaccgaaaattccattcaattaagtagaaaaggagaccccagtctgagaacaatcatgttttcatcaagaacaaggtaactaaactacttaaaatagggtccatccaggaggtaaaatactcggaatggttagaaaacgtaatagtagtcactaaaaaagggaacaaactaagaatatgtgtgtattataaagatttaaataaggcatgccccaaagattctttcccttttgccaaacatctatcgcattatcaattctacaaccggccccgagatcctcagttttctcgatgcttactctgggtacaaccaaatacgaatgaacccggatgatcaggacctccttcatccctaaatatggcatatactgctataatgtaatgccatttggattaaaaagtgtcgatgccactaccaacgctaagtaaactgaatgttcgaagaacaaatagggaaatccatagaagtttacattaacgatatgttagttaggtccttacaagcagaggaccatttaaagcaattgcaggaaaccttcagtatattgaagaagtacaacatgaagctaaatctaaaaaaatacacgtttggagtcggatcaggtaaatttctcgggtttatggtatccaaccgaggaatcgagatcaaccacgacaagatcaaacctattaaggatatcacggtagtggacaatgtgaatgtcgtagcaaggctaacctagaacattgccgccctagggcgattcatctcgaggtcctccgataagagccatcattttttctcgttactaaagaagaaaaactacttcacatagaccccataatgccaacgggccttggaagaacttaagcgatatttatcgagtccaccgctgcttcacatgccgagggagtatgaataactatacttgtatctagaagtatcggaaatagcggtaagttgagtcttagttcgggaagaacaacgtatgcaatttccaaattattatgttagccggacattaggtgaggctaaaactaggtatccttacctagaaaaattggcgctcgctttactaagtgcctctaggaaactgaaaccatattttcagtgccatcctatatgtgttgtgacaactgacccattaagaaatataatgcataaacacgaaatcttaggactattggccaaatgggccgtagaaatcagcgggtacgatataaaatatcgacctcagacagccattaagtctcaaattttggcagatttcgtggccgactttacgctgaccctaataccccaagtcgaaagagagttattggtaaactcgaggacatcttcgggaatatggaccctctttacggacgatgactcgaacgtaaaagggtccggactcggcatcatactgaacaacctacaggcaatatagttatacaatctaagagaactgtgaaattgactaacaacgaggccgaatatgaggccatgattgcaggtttcgaattggccaaaagcttgagggtagaggtgatagaagctaagtgttactaagtacttgtgttgaaccaagttaatggaccgctcgaagttagagaaaaacgaatgcaaaggtacccagataagttacatgtaacattatatcggttcaaagagtagactttgcagcatgtacctcgagatcaaaatagcgaggccgatgcgcttgcaaacataggcttgtcggttgaggtgacgagcttaattttggggtagtcgtacaactcatgagatcggtagtggaagaaggtcacaccaaaataaactctacaaggttaacttgggattggagaaaaaaatacgtagattatttgaaccggaaactacccttagatctaaaagaattgaggaccttgcgcacaaaggtagcccgatttatcctgtccgaggacggaacctgttcagaagaatgttcaatggcccgctagcaatatacttgtgactgggagataccgattacgttctgagggaagtccaggagggcgcctgcagaaaccattcaggcgccgaatcattggtttaaaatgtaattagagccagctattactggatcgacatggaaaaaaatgcaagggatttcgtacgaaaatgtaacaaatgccaaagacatgctccgatgattcaccaacccagggaactgctgcatttgatcttgttaccatggccattcatgaagtggggaatgagtatcgtcggccctcttccatgggcaccaagtaaggctcaatttatcttatttatgactgactatttttctaaatgggttaaagcccaagcgtacgagaagttcagggagaaggaagtcatcgacttcatttgggatcgcgtcatatgtcggttcgggatgccattcgaaattgtatatgacaacggaaaataatttatcagcagcaaagtgaccaagtttctcgaagatcataagatcaaaagaatcttatcgacaccttatcaccctagtgggaacggacaagacaaatcgaccaacaaaaccataatccaaaaccttaagaaaaggttaaactgatgccaacgcaaaatggaaggaaatcttgcccgaagtcctttgggcatatcgcacgacctcgaagtccagtaccggggctactccattctcagggagccaagtatcagattctgatatgcaacaaaggaataaaatgaagaggacatgaatacgagcttggagctattggatgaaagtcatgaagccgcccttgttcgattgggtgctcaaaagcaacgaatcgagaggtattataatcgaagggccaaccttcgatacttcaatattggggacttagtactaagtacggtcatacagaacacccggaacctgaacgaagagaagttgggtctgaactgggaaggatcgtaccaaattctcgatgtcatcgagagaggatcctataagctcggaacaatgaatgaggaacaattatcgagcaattggaatgtaactcacctaaaatgatattactgttaaggtacgaccccattcattttctcttatttgtattttgaactaacacttgcagttcaatatttgtattttgtctttccgagatctttcatctcgaattccttctttaaataatcaattgccttttggagttctataggagttccaataaggtttatgttattaacatatacgacaagtacaacaaattccgatgttgttttctttataaaaacacatgggcaaatggcatcatttatatagccttcctttaataagtactcactaagatgattataccacatttgtcctgattgctttagaccatataatgatctttgcaatttaattgaaaatatttcccgggactttgaattattaggcattttgaatccctcgggaattttcatgcatatctcattatcaagtgagccataaaggtaggcagtaaccacatccattaatcatgtcaagcttttcatggacaacaaaactaatgagataacggaacgttataacatccataacgggtgaatatatctcttaataatcgacaccaggcctttgtgaaaatccttgtgtaacaaggcgtgccttatatctttataccttatttttctcattcctcttgcgtacaaagacccatttataaccaacaggcttaacaccattaggtgtttggactacaggcccaaaaaattcacgttttgcaagtgaattcaactctgattgaattgcttcttgccgttttggccaatcgcgtctttgtcgacattctccaacagattgaggttcaagatcctcactatcttgcataatgctagatacaatattatatgcaaagacataatctaccactatatccacttgattcaaatttatctcaacatccattggatttattgatagttccttattttcttgagtcttaggctcagtggtttcttcatgaatctcagaatttaataaatcgtggatttcttcgtgagactctttcgtaatgtcatcttgatcatttgttttcctttttctaggatttcgatccttagattctaatgacctgctacgttttaggcgtgcttttgactttaactatgacactagaagatcgtccaacagggacatcaatacggattggaacattctctgcagggatatgtgattttgttatccttttcagatccgtaaatgcatctggcatttggtttgctattttttgcaaatgaataatcttttgcacctctttttcacaaatagaggcacgtggatcaagatgagataatgatggatttttctacaaaatttctggtttggtttcaccattttctctccctaattttgggaaaagtgtctcatcgaatcgaaagtctgcaaatcgtgacagatcccccgttaatgtttcaagatagcgaaatatgaaggcgattcaaactcaacatatattcctaaccttctttggggccccattttggtgcgatatggcagtgctacaggcacatatactgtgcatccaaaaattcttaaataggatatattaggttcatgacccaaaactaattgcaacgagaaatatttatgataatttgtcagtctgagacgaactagcattgctacatgcaaaatggtgtgaccccaaacagaaatgggtaacctcattttcataagtaatggtcttgctatcaattgcagacgtttaattaaagactctgcaagaccattttgactgtgaacatgagctacaggatgttccacttttatctcaattgataagcaataatcattaaatgcttgggatgaaaattcagcagcattatcaagtctaatagacttaattggattatcagggaattgtgcccgtaatcgaattatttgtgccattaattttgcaaacgcgaggttgtgtgatgacaataggaacacatgagaccatctagaagatgcatctattaagaccatgaaatatctaaacgacccactaggtgggtgaataggtccacaaatgtccctttgtgtatgttccaaaaatgcaggggactcaatcccaacctttgttggtgatggtctaataattaacttgccttgataacaagaagtgcaagaaaattcattatttaaaagaatctttaaattctttaatggatgcccatttgagttttctacaattcatctcatcataattgatccagggtgtcccaatcgatcatgccaaagtacaaaagtattggaatcagtaaccttttggtttacaatagaatgtgcctcaattgcactatttcttgtccaatacatgccacaagataaagataggaacttctcaataaccctcttttggccagagacattcttggtaatgatgatatattcaagattattctcatctattgtctcaatatgatatccatttcgtcggatatctttaaaactcaacaagttcctcttggacttgaaggagaatattgcattctctatgataagattgttcatttaggcagagttatagtagctcttccagagccttcagttagattactactattagaaattgtagtaacatctgccttacacatacttaaataagagaaatatttcttctctttgaatattatatgtgtcgtacatgagtcaattaaacaaatatttttacaattgaattgtgatctaattttgctttgagagatatccatatttgcttgtatttaaaatcaaattatagaatgtcaagaatttaaaagagaaaattaaagtaaaacacttaccttagatccaaaatttaatcatgaagaaagttcatggaacaattgacaatcattatgctcaatcccaaagcttctactcaattggttagagtctcgtgttgataacgtattataaaataataaaagaagaagaagagtattgcagagaaaagtagggagagagaattcttattgattttgagatgaataaaatgaaatagaaccctctatttatagggagagagtgacttagccaccaagtaataaatcctagaatctctctaaatatagacactcaccataaataaaattttatttataacacatccatatttatccactaaatgtttttttttagaaatgacctcgtcgttatcaaacgtattatatatgttttttattttttaatggagctacgactagcatattttatctatgaaattaatcatccatatgcccttatcttttttctttttaacattaaataacaattaaaccaatttaattggaacaagttacaaaaagagatttaacaaaatattttaataggactgattattggacgactgcgttgtgcgtcaattttgaaggaggaataagcaattacattcatacgcataattaggattttctttttgtcggatataaaccttcttagatactaacactgtttactgattgagtaacagtgcatactaacactatatatatatatatatatatatatatatatatatatatatatatatatatatatatatatatatatagtatatttttatttttacttgttcattctagcaaatcaggaaaaacaaaaaaattccccttttattctcaaaaaaagtaaaattttttttgatggggtttgcgcggtgcgggggagggggaggagtgggtggtgcgaaaaaataaaaataaaaatagaaaattaaatatacaaaaaaagtaaaaattaagggggtttgcttggcgggggggggggggggggggttagggagtagggtggatggtgcataaaaacaaaaaaccagaaaattaatacaaaaaaacggaaaacaaaaattttttgagggggtttccgggggaagggggggaggtagggtggtgggtgctgcagaaaaaaaaaaagaacagaaaatcgaaaatacaaaacaaaaaaaagaagtaaaattggggcaactaactaaatttctagataagttgggttaaaatccctttgttttgagtgagtttcatatataggttgtatttgagttgcttaatgagtcaaaatgagttataaaaaataatttattaatatgagctcaacccaaattgacccatgagctaatatacttgtagtccaacctattaatctctgggcgagttgtacgagttagatggatttgagctcaacttgacacccctatatataacataaaaaaaaaaaagggtgaaccataagtccctatcacttatagttatttattattttatgaaaaactattaagagattcattgcttttaatgtaatccaactaggatgcttaattttaatcaataattgtatacataagatgcttgaaatttgctaccacgtgtcagcaaaatgaaccccgtaagttacaataggctattcctattatatatttattatatacttctactcattgacgaatttaaaattttaaatttacctgtgaagtggcgaagtcacatgcttacaagggtggtcaactgatcaccttcgtcgaaaaattatattatgtatataaataaaatattacattttagaaatatataacacctattgaacacttttttcggattttttcccacttctttcaaatttgaatacccttgagtaaattcttaacttcgccaatgtgtgacagattggttggggtgggggaggtggggggtagggtgagtgggtgatgcagaaaataaaagaacagaacaataaaatataaaaaaagaaaaagtaaaattggggcaactaagtaaatttctagataaattgagttgagatccctttgttttgagtgttcatgggttgtatttgggctgcttaatgggtcagaatgagctataaaaaataatttattaacttgagttcagcttaaattaactcataagctaatatgtttgtagtccaacctattaatctctggatagattgggcaagttgaatggatttaagctcaaattaccaccccggtatatagcataaaaaaatgagtgaaccataagtccctgtcacttatagttacttattattttatgaataactattaagatattcattgcttttactgtaatccaactaggatgcttaattttaatcaataattgtatacataagaagcttgaaatttgctaccacgtgtcagcaaaacgaaccctgcaagttacattaggttattcctattatatatttattatatacttcttctcattggcgaatttaaaattttaaatctacatgtgaagtggcgaagccacatacttataagggtggttaactgatcacccttcatcaaaaaattgtattgtatatataaataaaatattacgttttaaagatatttaacatatattaaacactttttgtcggaatttttttcatttctttcaaattaaatacccttaaataaactcttagcttcgccattgtgacagattggtttaaattaccatggcaaggatacaaagttaattttgtaaatgtatgttttatgaaactattaaccaagagataaagatttaagaaaaatatgatggtattgtttttggatgaccaataaacttatttttttatcaccttgacttccctcatggttgaggtattatgcttttctcccttatttttattttttataataatttttttacctatttattatagaatttaaaaggcctgatatgacaaaattgccctttcatgttgcattaaactactgaaggtttgcttgattgaaacgattgacaattcgctagtaaaatggcattgaagatagcaaacaggtgtgataaaggctagatccacccgttacagtctctttggccaagttttccaaagttaaaagtacttttttttttattaagtattttttttaaagttaaagtgtttgatcaatattttagaagcaaaaacgtgtttttaagtagaagtagaaagaatttttaagaagtagaaaaaatagtttctcactaaaaatacttttttgaaaaacacttttgagaaaaaacacttagaagcaattttttaaaaacttggtcaaacactaattattgctcagaaatactactaattagccaaatgcaaactgtttttcaccaaaaaatactttttaaaaaaaacatttttagggctcttgtttacagagcgaatttaggattttaattttatgagttcaataatatttaataatttttacacataaatttacggcctacatcaaaattacgaagttcagttaagccttataactctattttcagatctattacaccaccaaaaaacctcaaaagactgaagaattttcaaacaatatattcttttattttattcagccagttaatttattgtagaatttttttctaaaaagatgattgcaattttagacagtgaaaatttattgtatcacaattttataaaattaaaaatatgtaggttaaaagaatttttactagaaattcaaaacaaagagaggtaagtgtaacatcttaaactaagaggaggtaagtgtaatggagtgaaagtatatgggccgatttagactttttaccttttctgtttattaacttgtctcacttatgatcagcatagaaaaaatatgaaggctggaggtctatttgaatgaagtgcatatatatactgatagaacaaaaagtgatttatcagtcaagcaatttcatttgaagaatggcaacaaaatagagtggagaaattaactaaaagtttagttgccctgcctttttttttttttgggttgttgagactattctaatgttgaacgcgaacccttcctttcacataattaagctaatctctgtaaattcaagctatgacaaaggaatttggctttggctatggaatttatcacatctatattccttttccttggtacattttctgatgatgaggtggatgaagaagacgatggctcgggtgagcgcgtacgactacgcctcgctgtaactctagccggcttaggcatgtttgagccgattaagtgaggaaaattgagccgagctctcgagccgcggattttgaaagcggcttgatcgtaagctaacgctgcatcctctgcggtctcgtaagttcctaaccacagccttgcaccttcacctttcctacttgggtctcttgtctccgccgaaaacgtcccccacggtcgccgtttcactcctatgtaccgcgtccaatctcgcggcgcgtttttctcacgcgccaccccagggccctgggttttctcctcggactcggagtacttttcatgggattcatgtgaaggattctgatcagttggtattaatgtttcctcagagttttcatcccaattaaggaagctgcagtcgaagtcgaagctgctaaaacttgagctaggactgttaggcaatatttcgttgctagaattcatcgacgaaaaaatttcagaaaaatctgaatcgtcaagaagatgttgctttatcgattcaaggagatgagagtcggagaaaaacaaggtttcgtcagctggattcatttccattgccataataaggttttggatgaaaatgaatgtagttttcttgctccttttaccttactaggggttaccaattgtggatgaacgaaaaggttgacacccacatctatttatatatgctttggtctattgcactagatcgtatcttcctgtttttcattaattatgttgcattctctctctgttaaagattttttaataccaaaatggtgtaaacatcaacactatacaaattaactccaattcattacattattttttacatcaaaaaaaatataccttgtatattctcctctttttttatattatattattaactttttatatattcatcacatataattcatattcctttcttatataaccatgtatttaatataaaattattttaaatcataaaattttaaataatataattataaccaaatattatacattatgcatgttatatttgtcgtgcatccgaatacaagtgatacaaattggtaataattgaacattagctacaaatgataattaggcaaactatagttatgtatgataattaaactttaagctgtagtgttttatgaaagttcaaaaaagaaaaaaaagggaatgtcagctaaaagaaccataaatatagttaaaagaccaattacgaccctgcaataattgaaaacgagattgtaaaactcggaatgcacgttcaacattttttcgacatgatattcttcttttgagaatgtggctcgcgaatagtttgcacaatattagactattttggatatatactgtcagtgttagctaatttattaaatgtttatttttatattatttaatgaatattgtgttatttattaaaaacatattatattttatatttgcaccttttatttttgtgatggttatattttttatacaattataacttgtaatagaattaacttatagtaatatataaagataatatatacgaaaattaatttataaaaatatacaccaaaattaagatgtaatttaatattataaagatattacataaaaataattatatatattagtgacctaatgaagaaagtaaaatttataatatgttaaattaaaagtgttatataataaaaaaaatatttatgaataataatggtgttgatgaatggtgtaatactattcatacaccaaaatggtataccaaataatacaccaaaataggtttggtgtaatatttaatataatgttggagatggtcttagggtaaaacttttgtgggacctttaatttgtttgactataaaaacttcttattacaggtgtaatgaaaagtaatttttttcaaacatacaaatatatcattctttttgaaactgattaataaggaaagtgtgtcacatcaataatagagtgggtaggagtttccgtgaaatttgctttttaagtagctgcatgttatgccttttaggtgcagtgtaaataacagcttgtttggatggttgttacgtatcgtttcataatgtatcgtatcgtaacgtattgtattgtactgtatcgtttaataaatataatgtttggatagattgtgtcgtttgccatcgtttcatgatatcacgcaccagtattatgaagaataaacttgcaatattgtaaagaaaaattatgatgcaaggtaaaattactatatataaaaagatagggtaaatgataaaataaaataatttaataataataaagattgagagaaaaagacaaggtaacgacgcgacaacaccaaatcgatcgttacataaagtgacacatttgatcgttatgtaacggtggatttacgatacgatacaataaaatttaagtaacaatcaaaacaaacattgtatttaaagtaacaatacgatgcgatacaatgcgtaacaacagtccaaacaagaaaattaagtactgatatatcccattaagaaatgaattatttcatcaaagggaattaaaaaatacagttctatgtgaatatggacatgaagtgcgacaaaagtactaacactattttttgaatgcagatccattaattttagacctagaggaagatctttacacgttcacataatctattgaatcccgagcagaaacgttttttatttgaaaaacaggcccagagattggtttatttgtatttttatttttgtctttttggtgaaaaatgagctgtcaaattaaatataaggaggagttatatacaggaaagtggaaaccgtgaagagctgatacagaaatacaattactaatttaaaagagatctggcaagcttttcctttcaacaaatttggcagctcattttatcaccaaaagaatatactgatatgtcaagctaagctacgccaaaatatttccattttgaaggtcgcaataaagatcttcgtgatctaaaatggatccgaatatttcagaaatgatcgtctctttgttattctgatgtatattatcactgttctttattactacctgttgcacaaaacaatattatacagagtataaaaatactccatgattatgccccattataataatactagacgttaatgtcttttcgcgttaaaccactcgccataagcatacatgacaattaaaacatactccctccggtctccttatgtcgcaaagtttgaatcgatatgatgtttaaaaaaagatagaaagacatctgaaacttgtgttctaaaataaattacagatatttatatgactttaaaaatttcttattaagggtaaaataaaatgtttgagttaaattattttcaaatttagaaagttgttattttttttaaaaacggactaaaaaagaaatgttaccgtataaattggaacagagagtatttttatatcatctagggaaataacatttttggtccctgaattattgggtaatactgattttggtccctattttattcgactaaatacatttaacctttacttaactcaaatatgtgcttttgatccttgaagctaacagaagctaaatcttaacaaaattattactttttaaaggtaaaaaagtttgttgtgacagtgcctctcttttgtttattttctttttttgataacttccatggaaatggagtttgcagctagagagaagacgaaggagaagaagatcagagtggagagaaagcagaaatgctctgtatttccaagaacggagggaaataaaaatatgtaactaactactgcacgtagagtgtagttatagttataactaactaactaactaactattacacatacatctctaatatcttaactaacttaagatgagctagatcctagctggaatgttgtaactacagcttgaacattgccttcacacgctcattgttcaacactgcccctcaagttgatggttgaaacaggttcttcactccaaggttccttagtagataatcatgttgtgctttgcttaggccttttgtaagtaaatctaccagttgctcctttgtagatacatgctcaattttgattggaccatgtatgatcctctcttttacaaagtggcaatctatatctatatgcttggttatttcatgaaagattggatttgcaataatttgtattgcagctttactatcacatttcaattgaacaggtaaatacacataaattcctagctctttgaacaaccccacaagccaagtaacctccgtagtgcatgaaaccatgcttctaaattcagcttcagctgagctcctagagatagtttcttgcttcttggattttcaggagataagagcaccaccaaacttcactagatagcctgtcactgtcctccttgtctccacacagcccccccaatctgagtcacaaatggctgttagcttgcttgttttttctgtaggcattaagagtcataggccaggttctgcctagatatatttcattgccctgagagcaacttctaggtgagatgtttctgggcagtgcatatattggctaagaacttggactgcaaatgccaggtctggtatagtcatggtgaggtatagtagtctacccaccagcctctaatagatacgagggtccttcaatttctcatctgcagctgcattgtcactttgcagccaagtatcatagtccacaaacaccatattttggttcaactctagtggagttcctgtaggtttagctccattcaatgatgattcagaaatgagctataaagcatattttctttgattcatcacaatgcccttctcagacatagtaaactcaattcttagaaagaattagagctcaccaagatctttcatctcaaacctattttgcaagtccctgctagtctgatccaatatgatttgatagttgcttgtgatcaacaaatcatctacatagactaagatggttgctatgtcatgacctgttctcttaatgaacagagaatagtcaaagtgactttgtctgaaccccatctgcagtaaagcctcaatcaacttcaagttccactgccttggggtctgtgtaagtctatagagggaaatttgcaatttgcacaccttctgggactccccctgtctagcagactcttcaggaatgtgcatatggactttctcttgaagctcttcattgagaaaaacattatgaacatccatccgatagagacactagtgccttgatgctgtatgtgctataatggacctcacgatcgccgtctcccccaaagacattcaatcacaatcacaatctcaatcactattttaatcacaatttcaagcgcaatcaccaccatgtgtgcggcatggcatacgatctcgacccgatcggctaggccgtctcaccataatgatgtgtggatcgacatcaccctttctatcaatcatctcatcccaattaaggggagtaacctcatcacatgaatcttatcctaaataaggggaataatcacaatccattcctataccggcacgtgtagtttcggggttagattatttcaacctacctttcctaggtgactaatgatactctcaaaaatatttattaaataaaggaatttcaactcatttcataatcttttacacatctcttcatttcattggcactagtggcaccaactgtaatatcattcttggcacgttggccgtatttcatatttcatgctcacctctttcactctcaaacatcatcatgggttatcaataacaaagcatttctaatcacagctttaagtacacatatgagcaattaagagacttaagcacattgagatttcttacacaatttggcataataactttcatttaaaacacgacttgaggtcataaaattttaatacacataccatactttgaacatattctcgaaggataacataacatgataagagaatccggaacatgttttgaacatatatctttcggcacaaagtttattcggcatagtccaatttataatgaataactcgggatatgagaaataaggaattgacacatcatacttgagacttacgagaacattatgggattctattctaagagaaaagtttagccaatataccccgctttgagcttttcttaaattactataatgttccgaaaatcctagcaaatcctaatctattctgagacataacaaaattgaatgcaaattaggaagatatttgtagtttcaactcatttgagcattttatcaaacactaggtgggcattatgatttcaaggtcctcctatggtggattccttcatcccacaacccaaagtctacccatttgagctcaacaaccttcccacaaaccttgatagtacatgcatgcataagtaacactctcacacccaataatcacactttccattaactatcttcttccccaaattcgaaattaaaaactagggtatgaaaccttacctcttagatgaagaccttgtgagttttccttgtgaattctccaattcttgagtaaggattgatgtaaacttttcttagaggtttctcctctcactctagagcacttcctttctctaaaaatatcagtttttctcttcacaaatggtcctttacgtctatttatcgaaataaggttgggttataaaatagaaaaatggacccttcaatcttaattctgcggtcgcaaagtggagtgcagaacaggtatgtgatccatataagggaccacaaaaatcactctccaaaacatgactgcttggattaggtttgctgttcgcagactagtgctgcggtcgcataatgcgccgcataatcttcctctggaaatcctcgtgctcattctgcgatggattgtgcagcccgcaaaatggttatgcagcctcataatggaccgcataatagtgctcaaaattggttcaatttctgcttcacttcgcggccgatctgtggtctacgaaagaaagccatgttctggaaaaatcattttaactccccgatacaatgtacaaccaaaacatttcgtaccgcggcgagcttgcgagccatgaagaatttctactatcctcaagtacattagccttctttggcaccataaaaccatgagttcaagtaaaattgtacggggacttacatcctcccccgcttaggatcattcgtcatcgaatgagggtaaaatctaccattatcatccactgtggcccaactattacttcatacaccagtggtaccaaattttaactaactccctaaattttcaaaatttttgccagagtttcccctgtaactgggcttatccgcctatctacctatccgagaatcccagaaaccaattttaacaaaatatacataatccaacgatgcaacataacatgacaacaacaccaaccgtggcctcataagcaatatattactaaaaggaacacccttagcataaattgtacaagtgatacataattcattgggaacaatttcatagaaacgattacatagctattcaaacaaatgagggcacttattcttcatttcttcctcggtcttccaagtagcctcttcaacttgatggtttgccatagcactttcacaggaggatatttctttatttctcagctttcgaacttgcctatcaattatggaaactataatctcttcataagtcaattcctcaataacctcaatagtttcaatcggaacaatggctgtcgggtctccaactaccttcttcaatgtagatacatgaaatatcgggtgcactaaagacatttctggaggtagcacaagcctataagccccctgaccaatcctctgaatgatcctgtactgtccgacatacctccgactcaatttccttttcttaccaaaccggggaaacctttaagaatactcaatcatcccctctgaactccaaatccctacaacgcacatcctaataggacttcagacgactctgggtagtttttgatcgctcattaatgatcttaaccttatccataacctgatgcacgaggtctagccctatcaaactctgcttccccaatctcgaactaacctatgagggatccacatctcctaccatataaagccttgaacagtgccatttgaatcctggcatggtaactgttgttgtaggcaaattctacaagtgggaaatgatcatctaagctacccttgaagccaagaatacaagcacgcaatatatccttaagcgtttgaatagtccactctgcctgcccgtcggtctgtggatggaagatttcactaagattcacctgagaacccaaaccttgctgaaatttcttccaaaaattagtcgtgaactgtgcccctcgatatgagataatagaaattggagtgccatgcaacttgactatttccttgatatacaactgagcatagtgttccattgtgtcggtagccttaacatgtaagaaatgtgctgattttgtgagtcgctccacaatcaccgtaattgagttgaacttgcgagaagtgcgaggtagtcctaccacaaagtccatattgatcatctctcacttacacattggaatttctattttttgtgccaacccactaggcctttggtgttcggccttcacttgctgaaaatttggacatcttgccataaagtacgctacattcctcttcatatcattccaccagtaaacttccttaagaccatgatacatctttgtagagcctgggtgcacggaatacctagacttgtgagcctcactcgtgatcctttcccggagaccatctacatttggaatacataatcgcccttggtaccttagtgtaccatcacctatgccaagagaaaaagccatcgtcttatgtttatgaatcccctctgtcaactgctcaatcaacagatcatcgtattgcttctccttgacttccacaacaagcgataattcaactttattttgcacaatcacccctccttcactagagtccgcaagacgaactcccaaactagccaaccgatgaatttccttgggaaacggcctttgatatgcccccaagtgagccaaactatccatggatttccggctaagagcatccgccacaatattagcctcccccggatgatatagaatatcgatgtcgtagtccttaagtaactcatgccatcttctcttcctcatattcaattccttctgattgaaatatatttgaggctcttatggtccgtgaatatatccatgtggaccacttaaaaataatgataccaaatcttcaatgcaaaatttacagccgtaagttctaagtcatgtgttggatagtttttctcatgattcttaagtttcctagaagcataagagatcgccttgcgtgttgcattaatacacacccaagtccgatccttgaagcatcacaatacaccacaaacccatctgtaccctctggtaaggtcaacactagtgctgtagttaatcttgatttcaactcttggaagatcttttcgcaagcatctgaccattggaacttaactgccttctgtgtcaatttagtcaacagagaggaaagagtagagaacccctccacaaattttctgtaatacccaactaatcccaagaaactgcaaatctctattggagttgtaggtctaggccaattcttcacggctacaatcttttgaggatcaaccttaattccttcactagagacgatatgacccaacaatatgacatattcaagccacaattcacacttcgaaaacttcgcatataacttgtgctgatatagggtctgcagaactaccataagatgattggttggtcctctcgattccgtgaatatacaagaatgtcatcaatgaacattatcacaaaggagccgaggaaaggctagaagactcgattcataagatccataaagtcattcgttagcccaatagacatgatcaaaaattcaaaatgcctatacctggtcctgaaagctattttcagaatatcctgctccctgagcttcaattgttgatactctaaccttaggtcaatcttagagaaatacttggcaccttgcaattgatcaaacaagtcatctatccttggtagtgagtacttattattgaatgtgaccttcttgagctgccgatagtcaatacgtatcctcaatgacccatctttcttcattacaaagagaacaagtgcttcccaaggcgacacactcggctggataaaacatttctctaataaatccttcaattgttcctttagttacttcaattccatcggcgccattctgtagggtggaatagatataggttgcgtgcctggcatcacatcaatcctaaaatcaatctccctatcgggtgggatcctagggagctaatccagaaagacctccaaaaattcattcacaactggcacagacttaagtttaggtgcctcaacatcagtgtccataactcggaccaaatggtaaataaaccccttgttgatcatcttcgtggccttaaggtaagaaataaacctaccctctggcaccacatcatcccccttcagctcaataaatagctcatttgtgaattcaaaccttacgatcctagctcgactatcaagcttagcaaaacacaaataaagccagtccatccccattattacatcaaaatcaatcatccctaattaaatgagatcaatcatggtatcccgaccatgcatcgtgaaaacacaatccctataaacctatgcagccacaatggactcaccaatcagagcagatgtcacgaccccagttctccctccgtgaattatcgtgacgacacctagtctgtacaactaggtaagcctagcaattgcgaaaaaagggaaaacaaccgataaaacaatttaaaaactgcggaataagcataatgaaggtttaaagatgccgctcggcatatacaatacgactcccaaactaaaaacacattcccaaaatgcggaatctcatgaaatcacaagctattgagtaactacaagtgtctaactctagaatgtctaaacaaaagtaaatacagaagggtttatattataagggagaattgaaaaagactcctcggtctgcggacgcggcagatatacctcaaagtctctggagaatcgcctcacctcaagggtagtagggctgagtcaaagtacctggatctgcatatgaagaatatgcgcagaaaagcatgagtacaccatagcagtactcagtaagtgccaagcttaacctcggtcgagtagtgacgaggaaggtcaggcactactaagtttaaatgaaaaacaaggtataataatatagaataagatagtataattaagtgcaacagtaagaagtaacacaagatagatagaacaacaacaactacaactgagataaaataatcacagaaaggaatacaactcaagacagagataacaaccgaggatctcctaggataactttctgtagtcccaaatataaatatctagtagatctctcgggtgatgtcccatagtccaactcatagtgcatggggatctcccggaataccaattcgtagtcccaaatgtaaatactcagtactgggggaatctaccgggtgcagtcccgtagttccaatataaaagtgcagggggatctcccggaataccgatccatagtcccaaagtaaacatgcaaggggatctcccgggataccgtcccgtagtcccaaagtaaacacatagaaacaacacgaagaatacacaattcaattcaaatttcataccaaggtaaaacgagtatatctaatctagcatgcaacacataattcaaataaggcagtttgagcaagtaaagcaattaagtcaattagacatacttccctaagctaacaacatgcttaaattgcaagtagtataaacaagaaaggaaacacaattaaagttacttaatgaaaacatgattttcaacaattagcacaagtatgcactcgtcacctcatgtacaaggcatttcaaatatcaacaataccaaatcctaataggagtttctccacacaaggttaggcaagccacttacctcgaaccaactcaaaatcaacccgaaaccacgctcttgtcacgagtactcgactccaaatgacccaaatctattcaaatcaattgcattatgtaaatataacttcaagtaactaattacactaatcaattctaagctaatacgcaaaattaggaaaaatgaccaaaacgcccccgggtccacgtctcggaatcgggtaaaatttacattttcagaatcctcatacactcatgagttcattcataccaaaagtaccaaaatcggacctcaaatggtccctcaactcaccactcaaagctctccaattaacaaagccctaacccacaatttaccactgattttccttcaaattttgtgcttacaatgataaatatcaccacaataatgagcttaagggccaaagaccttacctctatgaatccctatgaaaatctcccttgaaaatgctctccaaaacttctttccgttgaaaatttatgaaaaataagccaaattagcgaaggaaatctttttatactttctgacccaggttattcgcacctgcggtcaattctcgtttctgcgctaccgcttctgcggtcaagggaaacgcttctgcggttttcacttaagtccccttcttcgcacctgtgacgtagaatctgcatctacggtctcgtaggtgcggcacacctcccgcttctactgttttagctgtcttcacctttggccgcatctatggcagtgatatcacttctgcgggctcgcacctatgttccttaagccacaggtgcggttatgacagcaaactcaatagcttcagcagcaaattcccaactccaaacttcccgttaaccatccgaaatcatcccgaggcccccgggacctcaaccaaaagcacgaacaagttatataacactatccaaacttataccaatcctcaatacacctacaacaacatcaaaacatcgaattaaccatggattcaagcctaagaactccaaaaactctaaaattatgctttcgatcaaaaagtctatcaaaccttgtccgaatgacctgaaattttgcacgcacgtcacattccacacagtgcagctaatccaacttccgaaaatctattctgacccttagatcaaaatctcactatcgaatcagaaacttcaaaaattcaactttcggcatttcaagcctaaataagctacgaacctccaaaacacaatctgaacacgcccccaagcccaaaatcacccaacggagctaatggagccaatggaattccattccgaggccgtcttcacactgctccaactacggtccaaattctaaaacttaaactctcatttagggactaagtgtcccaaaactctctaaaactccaaataaatcctcctgtcaactcacaatagtagaaacaaacaagggaaaaacagttaataaaggattgaggcattaattcttaaaatgaccatctgggtcgttacagtagatatagagaacgactcatgaagctattctggttctatcccgaattccatagcaatataaggagtgacatatgacaaagtggaaccaggattaataagggcatatacatcatgagattagacagtcaatatacatgtgatgacatctggagaagcctctgaactctggcgacctctcataacatagaaacagctggatcctctcgaactctatgctctacccctagctgcaccacgccctgtgggtgctggagtgcctcgagctagaagaggtaatgtggatgtggtagctgtagaactagccagctgtgccgtgccttgcccacaccctggtgggacaaacgacgatccctttgaatgtgaccccttaatccgcacccgtaacatataggtaggtccatgtagcatattcctaagtgcatctttccacacctagggcatgggatcctccgctgctgctgaaatctccctccaagcggaccttgctggtaggatccccggttgccctgactgtgcctgaaatggctccactgttgctgattaggacctgatggaggtgacctaaccaaagactgagcaaaggactaggatggccctgatgaccctcctctaaatactaaccagccaccaccaccaccaccaccaccagaagaaccaccaaagttgcccgcatatagggccttattgctgccctctcgctctattactagtttgactttcccaataccaatatacaaaccacaccatgtctatggatccactaatagatacaaaagagcactatgaaagtgtcgtcaataaggccccggctatgcctcaaacaaaatacacgaggaacaaaagatacatgaccctaaaatgaagtggggctcaccaaatttgctaggaagagggtgtaccgctatcactgatcaatgccacctgctgtggaaccacctgcatccgttaaggatgcaactctcttggaaaaaaggacgttagtacatatggaataacactagtatgtatgactgaacaccctctcaatggaacaagtaataatacaagaatggacaattatagaatcaatggaagtctcaaacaataccaaaacatcaagttaggaacaagacaagtttccaagtaaatttccatattttaggttgggagatctttcgtaccgatataccaccgtgtatttagcacatagtccaatcgcggatcgatcgtctagggcgtctcacccaatgtcattcaatcacaatcacaatcttaatcataatttcaagcacaatcactaccatgtttgcggcatggcatttgatctcggcccgatcgactaggccgtctcatcacaatgccatgtgaatcgacatcacccttttctatcaatcatctcatcccaattaaggggaataatctcatcacaacaatctcatcccaaataaggagaataatcacaatccattcctacaccggcacatgtagtttcgaggttaggttatttcaacataccctttctcaatgacaaatgatactcccaaaaatgtttattaattaaaggactttcagctcatttcataatattttacacatctcttcatttaattggcactagtggccccaaatgtaatatcattcttggcatgttggccgtatttcatgctcagctctttcactttcaaacatcatcatgggttataaacaacaaatcatttccaatcacgactttaagtacatatatgagaaattaagagtcttaagcaacttgagatttcttccacagtttggcataataactttcatttgaaatatgactctaggtcataatattttaatacacaacccatactttgaacacattttctaaggataacataacatgataagagaatctagaacacattttgaacatatatctttcggcacaaaatttattcgagatagaccaatttatattgaataactcgggatatgagaaataaagaattggtacatcatacttgagacttacgagaacatcatgggattcaattctaagagagaagtttagccaacatacctcactttaatcttttcttaaattactataatgttccaaaaatccaagcaatcccaatctattttgagacataacaaaattgaatgcaaattaggaagatattcgtggtttcagctcatttgagcattttatcaaacaataggtgggcattataatttcaaggtcctcctatagtggattccttcataccatgacccaaagtctagccacttgagctcaacaaccttcctacaaaccttgatagtacatgcatgcataaataacatctcacacccaagaatcacactccccattaaccatcttcatccccaaactcgaaattaaaaactagggtatggaaccttatctcttagatgaagaccttgtaagttttccttgtgaattccctaattcttgagcaaggattgatgtaaaattagcttaggggtttctcctctcactctatagcacttactctctctaaaaatatcaaattttttcttgacaaatggtcctttatgtctatttatcaaaataggatcgggttataatatcgaaaaatggacctcccgatcttaactctgcagtcgcatagtggactgcaaaacaggtatgcggtctgcacaagggactacaaaaatcactctccaaaactgggctgctcgggtcaggtctgtagcgggtctgcggccctcagaccagttctgcggtcgcataatgtgccgcagaatctccctctagaaatcttcttgctggttttgcgatggattgtacggcccgcgaaattgttatgtgaccgcataatggtcctcaaaatttgttcaattttttatttcactccacggccgttctgcgatccacaaaatggttttgcgttcacatagtggatcgcataaatgccatgttctacgaaaatcatttcttcaactccctgacgcactgtgctcgtcgcgaataatttctactatcctcaaacacattagcctccctcggtaccatgaaacctcgggtactagtaaaattgtatggggccttacatcctcccctacttaggattattatcctcgaatgagggtcaaatctaccattagcatccaccgtggccgaattattatttcacacgtctagtggtatcaaattttgactaactccataaatatgcaaaaatgttgccagcgtttcccctgtagctgggcctatccacctgtcagagattcctagaaacaaatcctaacaatatatacataattcaacgacgtaacataacatgaaaacaacaccaatggtggcctcataagcaatatattaccagaaaggaacaaccttagaataaactgtacaagtgacacataattcatagggaacaattttatagaaacaattacatagctattcaaacaaatgagggtacttcttcttcatttcttccctggcctcccaagtagcctcttcaacctaatggtttcaccatagcactttcgtggaggaaatttctttaattctcatctttcggacttgcctatcattaatggaaactggaatatcttcataagtcaattcctcattaacctcaatagtctcaactgaaataatgagtgccggatctccaactaccttcttcaacgtagatacataaaataccgggtggactaaagacatttctgagggtagctcaagcctataagccacctgaccaatcctctgaatgatcctgtacggtctgacatacctcggactcaatttccctttcttaccaaatagcattatacctttcatcggggagaccttcaagaatacccaataatcctctatcaactccaaatatctatgacgcacatccgaataggacttctaaccactctgggtagttttcaacctctccttaagtagttttcagctgctccttaatgatcttaaccttctccatagcctgatgaacgaggtctgaccctatcaactctgcttccccaaacatattagcctctctcggcaccatgaaaccacgacttctagaaaagttttacggggccttaaactaacatgccgaggagaatgacccgatcccataagagtagtgttaccacactgccgaggtgaatagacagatcccataagagtagagaagtttacctcgttcgcagaaacacatacgagacgagaagacacagatctatagtttatcaaatattgtccaatttttccaaagtaagaggataagtcgatatatttattaaaatcctttatctcagttataataaagaaaattaacacacatgataggcataaaaagcacaattaaaggcatgctatgaatctaagtctacccgaacatatcatgaatatagctacatacagactctcgtaacctcgtatgtacgtatttccccacaacaagtatcacataaccattaatacacctaaggggataagttccctcttacaaggttaggcaagagacttaccttgatttcaaatcctcgatctggctcttcaacctcattagaactcctcaaatgacaccgaggactccggaactaatcaaaagtcatatacaataataaatatatgctcaaaagttcataattttgctattaaattaatttcccaaccaaattcgggaagtccataaaaagcaccccggacccacatgcccggatatcaaaatgttttgaataaaattgttacccataacttcacgaactcagatatataatttattcccaattacattatcaattttcgtggtcaaattttatatttaccaaaccataggttccaacaaaatcccacaatatttcccttaatttcatgttaaatctactcataatccgtgtatttaactgaagaattgatagggatcacttacatcttgatgtttatgaaaatcccccacaaaatgctcttaaaatcactcaagaccaagtgaaaaattaaagaaaatggactaagtcccgtattaaaaatcaagtctgcccattgatcccttcttcgtgatcgcgaaaaatgcctcacgattgcgaaggccaaaaagccactgcccaaaaaccttctttgtgttcacgtcccgacggatgcattcgcgatacatcactgcccggccttccatgttcgtgatccccaagtcacattagtgtaggctaaaagcctcctgcccaatttcctccattttctcttcgcgatcgcggttggacctccacgttcgcgaagcactgccaagccaacctttgcgatcgcggacccttcttcacattcgcatagaaaaataagctgcacctccaattttccttcttcacgatcgcaggaccatcttcgcaatcgcgaagcacaccaacgcaccaatagtgttcatccaagttcaaacatgctctgggtggtccgatacacaccttagccacccgagaccctatacaaatgcaccgttaagtccataaacacatcgtggacgtacttgaagcctttgaaaatataaaacaacactagaatcaagaatcacacctcaaacctcattaatcaacttctaagcttcaaactcatttcaaccaactccgaacgcgttgaaacatacttagacaactcggaatgatgccaaattttaggcacaagtcataaattatcatacggacctattccttggctcagaatcccaaaaggacctcgataacaccaaggtccactccaaaccaaatttaaagaactagaaaacctttaatgaactaactttcaacattaagtgccgaaacatccccgggtcacccgaacctcgattcaaagacacatcaagtacaaaattatcatacaaacctattgaaaccatcaaatcctggttccaatattgtttactaaaaatgttgacccaagtcaaacttgaccaccttagaccactattaaggaactaagtgttctgatttcaacccgaacccttccaaacccaaaccaattatccccacaagtcataaaatagtaaaagaacatgtaggaagtcttaattaggggaatgaggatctaaaaagcaaaactattagtcgggtcgttacattttacacttttaaacaaacgttcgacctcgaacagatctagaatcatacctggagtgctgaatagctgtggatatctgctctgcatgtcctccttggtttcccaagttgcctcctcgatcggttgaaccctctactggaccttgactacaacaatcttattatacctcaactggcgaacttgcctgtcaataatgacgattggctcctcctcataacccaaactctcatctagctgaaccgtgctgtaatctaatacgtgcaacctatcagtgtgttactttcagagtatagacacatgaaagaccggatgaacacccaataggctgggaggcaaagcaagctcataagaaacctcctgaacttgcctcacacctcaaatgggtcaataaacctcggactcatcttgcctttctttctgaacctcatgatacccttcatcggcaaaactttcaagagaaccttctcgcccaccataaatgataaatcacacgccttctgatccgcttaactcttctatctagactgcattgtgtgaagtcgctcctgaatcaacttaaccttctccaaggcatcctttactaaatcaatgccatataacttacccttgccagactcaaaccatccgatgggtgaatgacatctctgaccatataaaggcttaaatggagccatctcgatgctggactaataactgttgttataaataaacttgtcgaagggcaagaatcaatcccggttccatcagaagtcaattacacgcactctgagcatgtcctctagaatctgaatggtccactctgactgccggtcagtctgcgagtgaaaggccatgctgagctctactcaggtacttaattagctctgttctactctctagaaatgcaaagtgaactgaaggcctatatctgatatgatagaaaatgatataccatgcaatcagacaatctcctaaatgtaaatctacatcaacctatttgaagagtcagtagtcaccaccagaataaagtgtgccaacttggttagcctatcgacagtgaaccaaatgacatcaaacttcctcaacgtccgcgacaacccaactatgaagtctatagtgatgcgctcccacttctattctggtataaccatctgctggagtaggccaccttgtcctctagttctttgataagtggggattttgactgcttattagtgccttttagcttttgttttagtctaaaagcattgaattgtattcctgaaattgatcaaattgtgcaaaattacaagaatgatggaaactgagctcccgagatgaaatccgactaaaaaaggagtttccaaattacaaggcaatgaaaggcacaaaaacataaaagtgcggtccgcagaagaaatttgtggaccgtagagtaccttctgcggccgcaagacaagaagaacaacttttgtagagaattgtgcaaattgcggaccgcacatgaattgtgcggccgcaaaaatgtgttagaagttgaagatcagagagtgtgcaaaaagaccaagtccagagcttatgagaattacggactacacaaaaattatgcagccctagaagaatgccttgtggccgcatttctaaatctgcgaaccgtagaagaagtgtctcgcagccgcagttcagaattgtgttgtcgcagagcttcagttcctgttaaatgaagacatctgtagactgcacatggaattgtgcggccgcagaatgtcccaaggggaatttttgtccgagattttaatctttgtataaatagatgtgtttcacgaaattaggtcaagttttgaatctctaaagtactgtagccatttctctttgctattttaggaaactttagcttattttggtaatttaacattatatttctctattttaatcttctaatatgagttttattatcttttcttctttgttttcttctacacccgttatgagcagctcaatttttactagggttatgacccaaccctagtgttgaaaccatatgggtgattaattttatattcctttatgattgagtgtttattatttagcttagttcatgcttaaattgtagaattaagggttgcaaaaattgattcaagcctatttgacttagtatcttcttgagaaagagagacctagtctaggataacttagctaacaaaaaattgggtcaattgagagattgattaacctaattaaagggttcaatctagagatagtaacaaaccgtcttgagcttttaccaaccgttttggtagatacccatttgctcttgagaaaaccaaactaggtaaaatcactctctgatcgagatgtatcaagtgggaaacgtagtgttgtgagctataatacaccaattaacaaaacaagcataaatatctttatcccattaggcaaacacctaggtcatggtcacagctctagaccttttatacttttgaaaaaacccgcaagaacaattatctctagttttatatcttaaaatttgcaatcattagcttaattttagaagtagaaacaaaaaacctatttgtgtaagtgcaatctagatacttcacttacttattccaaatatatactaataattcccatcttaggtccttgaggattcgatcccgactctttattgcgttttattattgcaaacgaccatatcgtacctctttagagtcgtgcatttgtacgtgatcatgctcatacttaacctactggcaatttagaaatctcgctacatactcaactatgtccttcttcatccaccccatgaataatattgcctcgggtagcggtacatcttcgtagcacttggatgaatagtatattgagaactgtgcgcctcatctagaatattctccctctagccatcaacattaggaatacataggcgaccatggagtcacagaacaccatcctcaccgatagtaacctccttggagccaccctgtactaccgtctctctaagaaccaacaagtgcggatcattgtactgacaagccttgatccactcaagtaataaagactgagccacaacatatgcaagaactcgattgggctctaaaatattcgacctcacaagcctgttagctaaggactgaattgttacatcccatatttttgtatgttagattacttcgtaagccaattgatataagctcggaaatgagatcatctttgtaagtacataaagtaagttaaccatgttaaattggaggttataaatatttaagatcatgatttgcaagtaccaagagggttggaaggcttagaagctgaacgaatttaagaaaatatgttttgtcgaaagtcgacaagttgggaatgttataacatgtaattttggagtgagactagtgtgctcaaaatgataagaaggttatgttatgagttattttagtcttatgatagtcgtgtgttatgttttgaattcaagcgagttgtggaacaaaagttggcaaaatcatcacaagttacattcataaatatgctaaaacttaggtcaaatttaggtgatcatttctcccaatatacttgaaattatgggatgatctacctatcaaattgaatatctatgaatctagtttccaacagattaaatcgttcattgatataacattggattagagagatatttgcgtttttgcgagactgcacagacttaggtgacaagtaagtgaatcacctacttaccaaaaggataggcctcaattaaaagctcctaaagtcggccaaaatgggacttttaagggcttattaactcattaattttattcatctttcagaccaagaaaactagtttgaaaccctacaactcctccccaaaaattcacacaaatcctaggttatttagggtgttacaatgtgattctagtgccgaaaacaacttgctagtttctctttctccttattgtggccgcattgggggactgatttttgatgaagaagggataggtttcatgggttctatgaattgcaagataaatttatgcgtctcctcctattatatatgtttgtacgagttgtaactcaatcgtaaaggctaaacctagcaagtttcgaaagagtggtatgctgtttgttattgcatcacaattggctggttgtaaacatatttttatgttgaattcatggttgtttcataggataagaggcttaattatgtattttttattgtgttcctcaacttgaaagaaaagacaattcgaaacgtgttttagtaaactgaaaaatcagttttgcgttgctgaacttgtgggactattttgtaggttgttttgtgttgctgttgggttgtctcttttgctactatttttatggagtttgggaggagaaagggtgtggagaaataccacataatggcagggtggttgtctgatcgttcgttgttacattttcaggttgtttgacactactagggttgtcgttttgtgtatgaactgattaggctgtgtgggatattttgtggtattttgtgatggatataaggttgtaaagtgatgtatacatgtttttattattgtgttcttgttgtttttggtgttatgtcaaattgggaggaagcaaaaattatagaggagttacttcccgttttattataaaattatttgtcgttcgttgtgcgatagttataccttctataacttgattatagtattgttattgttgttgtagattaaggtggaacgagacaactttaacgtggtttttggataggtttgataagatatgttaaggctaaacctttcctttattttggcatgatcccataactatatgtgtttgataactagacataaagagaagttcgtattcctaaagttatgtacattatcctagtctcataagttacagtattctcctatatcgggactttatatttagtttagtattgtcgtctttcagccaagagagcagagagtccatatatattcagtattacaatattttcactaccaccgagctatattcggtgggcaggtccttattgggcaacctctaataagatggtaagttatatactgagcctaatatggccgagcgcctatgaagtagcctatagtgacctatatacaaatcctagtatgtccgagcgcctatgagtaagcctactacggtagagcagttatatgtaccgagccttatagggctggacatctatttaattgctatattgagagagttaagtcagtgtcatcatgtaagcatatcttcagatcatctttgactcccagttactttcagttattatattatcagttcagtttcaagaacaacaggtaagggcactagtacagagagaattattgataatgtagcctagattgaggccctatcagatcttgcatacaaatgtatgtatttcctacttaataccctaagacgggaatatctaacataccctaaaaatagtaggccatgggagtattataaggtaaaagtataagtttcaacaggtaacagaagcaaggtgaagaggggtactaggtacccagttaatgaagattatctgaatatccaatttaggtggagaaatataaggattctaagttaccttcaatagaagtagaggtatgtacaatttgccacacccatctcagttatgtctatgggacctaacatatataatttaagagaaggatgtgatatcaggatccagcttgggttagagtaacccaaaatggtggattgagccagatgagctaagagtgaaacaatgttttgttgaagttttcagaataatgtgatagatcaaaatattagcaggagaataaggagagaataaatgaagcattatgagtaaggtatgataaatgagtgataacggtaaatcaaaatatagtaggatgacatagtctatggtgaagtgaagaaaactacaataggtgacaagccttgagacaataaaagagtataatccatgaagttatatccttattttaagaaaatgagttggcgactccaacgtaattaccagaaggctaagttagaccccctcagagtaataacaataagcataggctagtaaacaagataaaccgaacatgaattatggaccagaggatttgataatagttggcatcatgagaatttctgagaccgtgttctggtaaaaataggatggacaacagaagaataaccttttaaggtcattcaagagtatgcttccctaaagcaagcactatgaatatagttaagcttaagggactaactgtgccaattacactaggtgtcaccattgtgcgtaaggaatttagatatccttggcatagaagggttacaacaaggcaagtaagagtcagtaaagacgtgaaaagatgccgaagatgaacatgtaaaatattttattggtaaatcttcaaagcattaaacgttattactcccttaaagagtggaagatggtgtgatatggtattattactcccttaaagagtggaagatggtgtgatatggtgttattactcccttaaagagtggaagatggtgtgatatggtatttagtcagagttaagtcgttcaagtaactatggaatagtaaaagaagtatgcggtaaaaagggcaaaagaaatgatattgcatttattcagatccaacagatatattacgactccagaagattatgcaaacacaataccggggagaggcggtaagggttccccactaggatgttattgataaataactgtgaattgacacttgatacataaggagccagtgaaagaggtaagttaagacaaaggacataacgcaagagagattacgcagaatataaatatgagcatggaccaacaaatagttaatagttgattcagaaatggcctagttatgtctatataagaggatacagataaatcagcggatcatgcaagctacgacatcataatctttgagaattaagataaacctagtgaaccccaacatagggaattaagtctcgcagatacgacatcgtaatccttgagaattagtcagataagagttgagatagttatagttgtcatatatgtgttagggatgttgatacccaatttttccggtattttttatatataaaatacctttcaaaatagcatgtattacatacataagtatgtcccaaggtcctgttatttttctcaaatttttaatgattttaaaatcagttttactgccctattttatcaagaaaaacccaataagtgttcccaaaattggcattttggtaattcatttattggattctcatatttatactaaaatatagctagtatgattttttcacatttttaaaaatgtatttagtattttaaaaaaagaagctaaattgcatataattgcaatattagtctactttaagatttaattgcgtttataattacaaaattagctccagtatttttagtctagtatttatatattattaattaatttagtacctttaatttgtttccagaaattattttactattttttataaaataaataagggaaaatggctatttaaatgttagcctgtttttacttcgattttggccagatttggcacccctattccaacacaatttcaattgcccagcccaattcaaaaattacccgacccacaaccttgaaaaaataacctacttggccctcctttaaatcccagcctttgatctaacagatcaatgactcacgttctccctttcctttttaatttaccaacaccccaagcctaatcattttgtcaccagtagccgcctttgaaacctccactctctcaaactctctcaagtcttcttagaaccataaccgcctcttaccgctttcaccctgaaagccaccagaatccatggcttccagggctgtgagagtcttatacctacctcttgttgctcttacacacctgatctctgaagattcaaggcttgaccttgaaggtttgtacctagacctctatcgattcgaggttctacgaccatctctggccttgctccagcgtaccatggttgtttgagcctgatcctgacctctcagactcagatcagtgacttttcaaagcctttctcatttctagggttcttctgaaaccctaacccttcgagattttccgattcccttagatctgttccggatccatgctttccttaaggtcttaaacgttttcctgacttttctttcaaaaaactactttcaaaatctttcttttccgatctagggttttctgaaagtatttaagtgttttctaactttctttttccttttatgtgtatttgcttctactgggttcttgtattttcttctaccatgttcttaccttcttctgctgtattttcctatactatgttctcgtatgctcctctactgcatgatttctctattgtgttctgatatgtttatcctactgtattttcttactatgttcttaagtttgcttattaagttccttttactgagttctgtttaaagattcttctaaaatttcttagcatgcttcttctactattcttatcattcttctctattatgtttcgtattagcttcttctactcttattttctttgaattctgctactatgttctgtgtgttacttgatatcattgtgttatcatgagtttctactgttaaaagaaatatgcaagaggtttcatagaactgaaacctctgagcctgtttcgattacttgccttttcatctctatacttgattcaaggtggaaaccctagaattcgggggttctgccaagtttgattatgtgatttaattgaactagggtttttattttagaacccctaactctttcggaccaacttcgagtctctgaacctagtttggacatctgtgtttgcatatgattctgacctttggctaaactcttctaaaactctttcttcgctttatttttttttattgatttttgcaatggcacaacattttctttcaactcaatgtgtttgtgtgctctttatatgtgatgaatcttcctctaaaaaggctttcaactcgtgattgattcaaattccttctaaataggtctgattgattccctttccattgtttgctgatttcccttaagataaaaaacctttcccatctttttgactcggttcattcatacaagatccctgacctttgatttactgcttgttaactgattttcttgccttgtttgagcaaccacatatttcaaaaattctgtccttaaataacctttatgtatttacctttaattgcatgttgtgcacaaagtgcttattcatttttctttccttaaattgtttttacctatttgaatatgaatccattaattaagggaaatcttgtgtaattgtttgacaatcagttccttgactattttcttaccttatttcttcatgattttcacactataaaaggcacgaccctttttcaaaaagaggacatcagaatcctcctgaactcatactctctcacaataactttctcttcttgtctgtattgtggcctgtttacaagacctaatacttttctttgtttgtttcctttaaaactgatatgtcctgatttaagcttcagcaccacaacaatgtgtttatttacagtctttgtatccatgtctactttactactttctgtagagttcaacatttaaattagtatgcttatgtcctactgcttgtttctgctatgaatcatcgcccctatttccctttatgtggtttgagttacagtttaaaacatggcaatatgcaagttattgtctatggattgaacttgatcccttagaggatcctaacctctaaacaatatgttctaacaggcttatgggtgtgccagcatttcccattgcagggtatgcccactagcctgtcttttcctatttatcacctccccgttccctatacccctatgtgtattaatgtaaattgtttcccttcccccttttcagaattctgcacttgcaccctctcttagtctctaagttctgccccctcttgtgagccttgccttgggaccttgagttccctctgaacttggacacttgagggctagcccttccacaatgcactatgtcttcatctataatgtatttgggtgtgagcattgcccggagtccatatgaggctcttagggaactctagcacatccaaatcggagaaaggctttgaaataagatctcttggagttggtttacttcatacttcagacaggaagtctgaatcaggctctcattggctgtactttttctgattgtattttttctttactttactctttctgggatgtaataactttgtaataaaactctcggggatggctagtgaaaagggaggggtaactatgtatgcaaaaaggggtagataacctgcctataggagtatgtgtaagtcatgctatttgcttgctttctttgtttaaaggaggtctgtttgagccttttcatttgtttatatgcttccccatacttgccatatatgttttgtttgtcacctcagtatttttaccttttgaattcacaagtaagcccaatatcgctcccctttaggattagtagtcccaaatgcctccgggactgataggattggggtgggtaatagtatgcaataagtaaactagaccattccgcagtttaataccttaaacagggcgggaagggtagatatggatatgatgaccacacggtaacatcacgtgtagcccctcactgaggagtgattaccagatgttgtgtggggtgatccatattattaataaacctaggaccccctcctttcttttgtttcttccttttaaaccttttaaactgtttcttcaaagtcaactcttttagttttcttacttgtaaccctcatgtgcaaaatcccctcttatttgaagtcttattcgcctacgtgttgtttgcgcttaaagtcacaataattgtctcgccgggaaccacactagtgcatccagaggggtgcctaataccttcctcttgggataatttcaagaccttacccaatatctggttgttcaaatcaaacctttcttagtgtcttaatgcacttaaatcattaggtggcgactattcaattcaaacccaattcccgaaagggaacgagttgtcctcccaaatgtcataaacccgatttcgcgagaaaaagagggcgcgacagcgtggagactctgcttgggacttttaggtttttaccatttcagactattattgtgaatttatgtttctttatgcgtacttatttgtttatttcttttaagcattcaatttccttttcgattgcaaaactgacttgtctttttgtttcttccctttattactttcctttactgctttcctttactaccactttaagttatgaaaagctgttgtatttactgctttcctaacgtgctcccttaagttgtccgcttaagggtaccagtctaaaaccccatggaaaccttactctgtttaactgtgcatgtatcatggtcaaacctagccgggtcagttatgttgtccacataatgaccctttaagatagcattgtccaaagtccactaggtttccctaaaacccaaacggacatcatcatgttctatgcatttatttggagaactagatgcgtttatgctgattgttgatattaaattgacgagtctggtaggggtaagggcctaacccttttgttttgcagaaaatgaggcacgaggtgcccagttttggtatggctagcataccctaactcttgctagactggtggagaagtcttccatcaaatgaccaaatcaacaagtggaaagagagggccgccaaagctagcgaaaagttgaaatatctagagtacagtctactggaattggaaggaaaagtgaggaagagaatcaccgactgctagagcaccgagggaaatgaaggagaactcctagcaaaggcatgtttactggtgcacctatgcgaattggaggatctgatcaacgagagcattcaacctgaggaaggtccttccgggacaaagtagataggagcttgttcttttgctttaagaaatgtaataaggcccatggccattagtgattttcatttcttgtttatttagtgtcgatttgggattcgtctactttttatcaataaaatgaggcatttagcattctaagttctccaaatcaacttatcactaggcctatatcgagcacaaagaggttcccaaataggacacgatttacattcttccactatgcgtttaaatatcgcaacattttcttataatcctcactgacttgttacttttttgtttttactttttgtttatttattcccatcccaaaggttagtttgtgcaatctggcatcgtcatcatattccacaagatcaaagggccatccacccacccttcctcctagtcctatcagaagcaggaacaaagaaaagatggaagatttgaacaacaccagaaaggaaaacacaactgaacgggtagaggtcactcatggtgctcaggtctccaaacaaagtgcgtcccaactcgagcagaaactgttgaaatttcaggaggaacttgatcaagttcggaatctggcaaatttgtcatttttgctcaccactccagctatcaattttccaaacgctcagaaccccacatatccaaaaaacatcccaaaaccacaaaaccatcccgctcctcaccaccactgccatacttgccacacatccaacaatactccactgctcatccccgaacctttgaattccacaaatgaccatttccacgctcatcataacacccccatctacgtggaaaccatgccacactccacccaacccatctcaaacatacccaagtctgatgataaagactcactcatcaggaacctggttgtagaactcaagaaattgactagtcgaattcagggtgtcgaaggaagtaaggggattaaaagggttgaactacgaagatctttgtatacaaccggatgtcaaactacccgaggggtacaaaccacctaagttagaaatgtttgatggtacaggggatccgagagtccacttgagaacatactgcgacaagttggtcagagtagggaaagacgaaaggattcgcatgaagcttttcatgaggagtctgagaggatatgctctgtcttggtacattagccaagaaccaaagaaatggtcgaactgggtgagtatgacatccaactttatggacaggttcaggttcaacacagaaaatgcgccagatgtgttctacatccagaatttaaagaagaagaccacagaagcattctgcgagtacgctactcgttggagatcagaagctgctaaagtcagaccggctttagaagaagaacaaataaacaagtttttcgtccggactcaagactcatagtactatgaaaggctgatgttgattgagagccagaaattttccaacatcatcaaactaggggaaaggattgaggaaggcatcaaaagttgtatggttactacctttgaagctttgcaagctaccaataaggctttacagtatggcgatacgtccaagaaaaagggacgtaggtgccataatggttgcacaaagagccaaatcccctatcaaataccaagcctatcctatacctccactcacatatcagcctaccccgaattaccaagaaccttaaccctctcaccaaactctaccgcccacttatcaatcatccccacctcctacatatcaacctacttcacccagatattcccaaaccacacatgtctaccaagcctacaattctcagccatcccactatcaatcacctcccacacgttaaaacatttcaagacctcgaccaaatttcaaccgcagaccccccaaatagtataccgccattgctgagccaattgaccagctatacgaaaggctcaaagctcctggttatatcacccctatccattctataacccatgaaaacccttctcaatgggttaatccaaataaatcttgtgcataccattccagcatgaaaggcataccattgatgaatgtcgctctttgaaagacaagatccagactttgattgataataagatcattatggcaaaggagcctactccgaatgttggcaacaaccctctgccggaccataagggtggagatgttcacatgattgaaatagaggatgattgggatcccaaaggatcgatcggtttaatcacagaaggttacaaaccaaaaaagccaatagtcacccttaatcagattgtagtccatactcagccttctagggatgccgaggtaaacatgtctgtaccacttgagtttgaagcaccaccccctacaaagacgccaacaccaatttaggtcaagtttgggtttccatcaaacacaccagcactgtttgaagttgcggttttaccctccaaaattcatgctccattcggagtaaacgtgcccattccagtagcaatgtcggtcataacaccgtttcatacaaatgccataccttgggattacacagccgaggcgagaaggaaagggaaagccaattttggggaaacagttgcggcacagggtatgacaagaaccgacagggtttatactccggagcatttagctgagtcaagtaagtaggcctctggtcagccgaccatcactaaaaccaggctcgatgatctctggagaaagatacaagccaaggaatactcagtcattgttcagctgaaccaaacactggcataaatttctatcctagctttgctgcaaagttccgatgcacataagaataccttgttgaaggtgctgagtgaggcacatgtaccaagaaaaatcaccggaggagaaatggaaaacatggtagggcaggtattagaaagtcacaagatcacttttcatgaagatgagctgccaccagaagggttgagtcacaacaaagcattgcatatcaccgtgcaatgcgaagattattttatcactaggatcctgattgatggagggtccagccttaatatttttccattggtaacactcagaacattgggaaaggggctacatgagatcaaggatggggccatcaacatcaaagctttcgacggttcccaaaggtccactattggggaaattagcttgtgcttgcaaatggggcctacttggttcgatatcgatttccaagtaatagatgtgccaacatcttacaacttgctattgggatggccgtggattcatgccgctggggctgtagcatcaacactacatcaggcagtgaagtttgagtggaatcaccaagaggtgatcattcacgacaacggtagcaatcccatatacagtcgccaaaccatcccagcaatcgaagaaagaagaaaggtaggcggggaaacctagcaccacatcgagcgagtcaacgccgttgacaaagacaaatggtgggacaacaaaattgaaagcatattgaactggagcggatatgaacctggcaagggacttggcaataacctccaaggaatagccaagcctatcaaactaaagaaacatggcaccattttcggtctgggatatgagtatacttgggaggaattcaacaactggtcgctactatggcgcgtgccatactacccgctggagtagccaataccacatttggagcagactttccagccagccgatattatctatgggtcggatgaagaagaagcaccggaagcagagaggaatttgttcctagaagacgatgatatggactgttgtgttgttctcgaggaggagggggtggaaggcccttccatacaggccataagtcgaggagcatgcttaacaattggaccatcagaaccaccagagcctggaaagcctcgggatagcaaggctgaacaaagcatcatgcactatcttttatttttactatttgattttccttttgcattttgaattttcgcaataagatcttccaatgttcaaaacagttatcaaatttatcaaagcatttcggtttccttacaaatcttactcttattatttcttctcattactttatttatatagcattactattacctatcttgatgaaccaatgactgtgacatgaaacgagacaacgcaacaaacagacatagattcagaggaagatgatataccagaagagattgttaaagaagtcgagaactttgagaataggccaaagtccaacctggacgagactgagattgttaacctgggagatgcagaaaatgtcaaagaaacacgaatcaacattcacttattaccgtcagaaaagaaagagtacgcagaatttctaagagaacacgaggacatattcgcttggtcatattatgacatgactggtttgagtacatctattatggcccacaaactgccaactgatccgacatgtccatcggtaaagcagaagatcagaaagttcaagactgatatgagtctgaagatcaaagaagaagtcactaagcaggtcaaagctaaggttttcagggtagcagaatatccgacatggttagccaatattgtgccggtgcctaagaaggatgggaaggtcaagagcctgtgtcaactaccgggatcccaatcaggctagtccaaaggacgacttccctttgctgaacatacaccttcatttacatcttgcatggctgaaatatcgccacttcatttacatcctgcatcggctgaaagatcgccacttcatttacttcttgcatggctgaaatatcgccactttatttacatcttgcatttctgaaatatcgccactttatttacatcttgcatgactgaaatatcgccaccttatttacgccttgcatcggctgaaatattgccacttcatttacacttgcatggctgaaagatcgccacttattgtatttcatgggctgaaagatcgccacttactgcattccatggctgaaagatcgccatcttcacacttgcatggctaaaatattgttgctttattttatgtttgtatggctgaaagatcgtcacttattgcatttcatgggctgaaagatcaccacttactgcattccatgggctgaaagatcgccaaaattgtccaaaggcatcattgtttggaggcaccattttcatagcccgagaacgccatgcctggcttgaggaccccttttatcttttgcatatcattattcaaaggcgtcatagtttggaggcatcattctcatagcccgagagcatcatttcatggcatgcgaatcccttatcatacgcttcatggcccaggacgtcatggtttgaggacgtcatcctaaacgtccaaagacaacattcatggtccaacgggaacttgcatcacatttaaatttccgcacaatatacacttgtattgcttatttgcaggtaaaccggcaagcaacgaccgtctcaataggagcaatcctgctccagttcccgctgccctattagactttaaccatccatcccaacgcaaatatcgtgtccgtcttgaaaaatctccatgggcatattccgccgacggatcctgaactacatatggcctgattcttgtaacaccagagatatgtaggtagcttaggagccagagctcggtaaaattcttcaaaccattccgttcggtcaaattggccatcatatcttcacccgacaactctttcatccttctcgggtaaagaggggcagctattgatacctaattttttcctatattttttatttgtaaaatacctttcaaaatagcatgtatatacatatataagtatgtcccaaggtcctattattgttttcaattttttaaagattttaaaatcaattttattgccctattttatcaagaaaaacccaataagtattcccaaaattggcattttcataattcatttattggattctcatatttatactaaaatatagctagtaagatttttgcacatttttacaaatttatctagtattttaaaaaaaagctaaattgcatataattgcaatattagcctactttaagattaaattgcgtttatatctacaaaattagctccaatatttttagtctaatatttatatattattaattaatttagtacctttaattttttttgcagaaattattttactattttttataaaataaataaggaaaaatggctatttaaatgttaacctgcttttacttcgattttggccagatttgacacccctaatccaactcaatttcaatttcaattgcccagcccaattccaaaattacccgacccaaaacctttaaaaaataacccacacaaccctcctttaaatcctagccgttgatctaacagatcaacgactcatgttctcccttttctttttaatttgccaaaacccccccaaccctaatcattttgtcaccagtatccgccttgaaaccctccactctctcaaattctctcaagtcttattagaaccctagccgcctcttaccgcttccaccctgaaagccaccagaatccatggcttccaaggctatgagagtcttatacctacctcctgttgctcttacacacctgatctctgaagattcaaggcctgaccttgaaggtttgtacccagacctctgtggatttgaggttccacggccatctccggccttgctctggcgtaccatggttgtttgagcccgatcctgacctctccgactcagatcagtgactttttaaagcctttctcatttctagggttcttctgaaacactaacccttcgaggttttccgattcccttatatttgttccggatccatgctttccttaaggtcttaaatgttttcctgacttttatttcaaaaaactactttcaaaattcttcttttccgatctagggttttctgaaagtatttaagtgttttctaactttctttttccttttatgtgtatttgcttctactgggttcttgtattttcttctaccatgttcttacgtgcttcttctgctgtattttcctatactatgttctcgtatgctcttctactgtatgctttctctactgtgttcttatatgtttttgctactgtattttcttactaagttcttaagtttccttttactgagctctgtttaaagtttcttctaaaatttcttagcatgcttcttctactgttcttatcagtcttctctattatgtttcgtattatcttcttctactctatttttctttgaattctgctatgagtttctactgctgaaagaaacatgcaagaggtttcatagaactgaaacctctgagcctttttcgattacatgccttctcatctatgtacttgattcaaggtgaaaaccctagaattcgggggttctgccaagtttgattatgtgatttaattgaactagggtttttattttagaacccctaactcttttggaccaacttcgagtctctaaacctcgtttggacatccgtgtttgcatatgattctgacctttggctaaactcttctaaaactctttcttcactggattttttattgatttttgcaatgtcacaacattttcttccaactcaatgtgtttgtgtgctctttatatttgatgaatctttctctaaaaaggctttcaactcgtgaatgattcaaattccttctaaataggtatgattgattccctttccattgtttgctgatttcccttaagataaaaaacctttcccatctttttgactcggttcattcatacaagatcattgacctttgatttactggctgttaattgattttcttgccttgtttgcgcaaccgcgtatttcagaaattctgtccttaaataacctttatgtatttacctttaattgcatgctgtgcacaaagtgcttattcatttttctttctttaaattgtttttacctatttgaatctgaatccattaattaaaggatatcttgtgtaattgattgacaatcagttccttgactattttcttaccttatttcttcatgattttcacactatcaaaggcacgacccttttcaaaaagaggacatcaaaatccttctgaactcatactctcttacaataactttctcttcttgtctgcattgtggcctgtttacaagacctactacttttctttgtttgttttctttgaaactgatatgtcctcatttaagcttcagcactacaacaatgtgtttatttacagtctttgtatccatgtctactttactactttctgtagagttcaacatttaaattagtatgcttatgtcctactgcctgtttctgctatgaatcatcgcccttatttccctttatgtgctttgagttacagtttaaaacatggcaatatgcaagttattgtctatggattgaacttgatcccttagaggatcctaacctctaaacaatgtgttctaacaggcttatgggtgtgccagcatttcccattgcagggtatgcccactagcatgtcttttcctatttaccacctccccattccttatacccctatgtgtattaatgtaaactgtttcccttcccccctttcagaattctgcacttgcaccttctcttagtctctaagttctgccctcgcttgtcagccttgccttaggaacttgatttccctctgaacttggacatttgggggctggcccttccacactatactatgtcttcatctataatgtatttggttgtgagaattgcccggagtccatatgaggctcttagggaactctgacacatccaaatcagagaaaggttttgaaataagatctcttggagttggtttacttcatacttcaaacaagaagtctgaatcatgctctccttggttgtactttttctaattgtatttttttttactttactctttctgggatgtaataactttgtaataaaactctcggggaaagctagtgaaaagggaggggtaactatgtatgcaaaaaagggtagagaacctgcctataagagtttatgaattcctgcattctcatataaacaccatgtctataggaatcttgcattctcatatagataccatgtctctaagaatttctgcattctcataccatgtctataggaatcttgcattaccatatagataccatgcctataggttatttctgaatttctgcatatcatatagatatcctacctataagaatttctgaatttctgcatatcatatagatatcctgcctataggttctttctgaatcttgcatatgcattcctcattaggaaaacatgtttgtaggtcttaataatcaaccgcaattagatatcatgttcatagatcttaaatgaaattcaacacctagatgccatgcctataggatttctgcactttgctatgtctatgaaagtgtttaaatcaacaacgcctagaaagcatgcctataagagctattaatctagtctgaactgtttcactcacctataagtctaaaaccgacaataatgatgcattaccagttgcagaacttatgatcgtttgctaaaactcacccttctttaataactaacacattctcttaaatcagtatgtaatcatctcatatcccttgttcttgaagtctatagatatcacgcctatagggttttcatataacacttaggcaagccatagggtaaaagattataaattgaatcttttgttattaacaacaaccagctggtagtcctgattcgggtttcttatctaaattatgtgataaatcaaactgcctcaacccttaagtttaatcaggccctaaatagtatgtgtaagtcatgttatttgcttgctttctttgtttaaaggaggtctgtttgagatttttcatttgtttatattcttccccatacttgatatatatgttttgtttgccgccttagtatttttaccttttgaaaccacaagtaagcccaatatccctcccctttaggataagtagtctcaaatgcctccggtactgataggattggggtgggtaatagcatgcaataagtaaacgagactattccgcgctttaataccttaaacagggcgggaagggtagatatggatatgatgaccacgcggtaacatcacgtgtagctcttcactgaggagtgattaccagatgttgtgtggggtgatccatattattaataaacctaggaccccctcctttcatttgtttcttccttttaaaccttttaaactatttcttcaaaattaactttttagttttcttacttgtaaccctcatgtgtaaaatcccctcttatttaaagttttattcgcctacgtgttatttgcgataaagtcacaataattttctggccgggaaccatactagtgcatcctgaggggtgcctaacaccttccccttgggataatttcaagcccttacccaatctctggttgttcagatcagacctttcttagtgtcctaatgcacttaaatcattagatggcgactattcaattcaaacccaattcccgaaagggaacgagttgtcctcccaaatgtcataaacccagtttcgcgagaaaaagggggcgcgacagcgtggcgactctgcttgggacttttaggtttttaccatttcagactattattgtgaatttatgcttctttatgcgcacttatttgtttatttcttttaagattcaatttccttttcgaatgcaaaactgacttgtctttttgtttcttccctttattactttcctttactgctttcctttactaccgctttaagttatgaaaaactgttgtatttactgctttcctaacgtgcaaatatgtgacaatctgctttagttattgcataatcatgctcaacgtcatattccactcgtgccaaacaaaataccatagcaacgcttataatgagtggttacgctcttccaatattatcaccccctaaatccggaaaaggcatatttgcggtaaaaccagtctattaacggtgtagtcgacggttccgtgtctttcccccttaactgtgcatgtatcatggtcaaacctagccgggtcagttacgttgtccacataatgatcctttaagatagtattgtccaaagtccactgggtttccctaaaacccaaacggacatcatcacgttctatgcatttatttggagaactagatgcgtttatgctaattgttgatattaaatagtcgagtctagtaggggtaaaggcctaacccttttgttttgcagaaaatgaggcacgaggtgcccagttttggtatggctagaatcccctaactcttgctagactggtggaggagtcttccatcaaaaaaccaaatcaacgagtggaaagagagccgccaaatctagcgaaaagttgaaatatctagagtacggtctactagaattggaaggaaaagtgaggaggagagtcaccgactactagatcgccgagggaaatgaaggagaatacctatcaaaggcatgtttactggtgaacctatgcgaactggaggatctgatcaacgagagcattcaacctgaggaaggtccttctgggacaaagtagataggagcttgttcttttgctttaagaaatgtaataaggcccatggccattagtgattttcatttcttatttatttagtgtcgatttggaattcgtctactttttatcaataaaataaggcatttagcattctaagttctccaaatcaacttatcactaggcctacatcgagcacaaagaagttcataaataggacacgatttacattcttgcactatgtgtttaaatatcgcaacattttcttataatcctcactgacttgttacttttttttttttactttttgtttatttattcccgtccccaaaggttagttcgtgcactctggcatcgtcatcatattccacaagatcaaagggccctccaaccactcctcctcctagtcctatcagaagtaggaacaaagaaaagatggaagatttgaacaacaccagaaaggaaaactcaactgaatgggtagaggtcactcatggtgctcaggtctccaaagaaagtgcgtcccaactcgagtagaaactgttgaaatttcaggaggaacttgatcaggttcggaatctggaaaacttgtcattttccctcaccactccagctatcaattttcaaaacgcttagaaccccacagctccccaaaacatcccaaaaccacaaaaccatctcgctcctcaccaccactgcaatacttgccacacatccaacaatactacactgctcatccctgaacctttgaattccacaaatgaccatttccacgctcatcataatacccccatctacgtggaaaccatgccacactctacccaacccatctcaagcacacccaagtctgatgataaagactcactcatcaggaacctggctgcaaaactcaagaaattgactagtcgaatttagggtgtcaaaggaagtaaggggattaaaagggttgaactacgaagatctttgcatacaaccggatgtcaaactacccgaggggtacaaacttcctaagttcgagatgtttgatgctacaagggatccgagagtccacttgagaacatactgcgacaagttggtcggagtagggaaagacgaaaggattcgcatgaagcttttcatgaggagtctgagaggagatgctctgtcttggtatattagccaagacccaaagaaatggtcgaactgggtgagtatgacatccgactttatggacaggttcaggttcaacacagaaaatgcactagatgtgttttacatctagaatttaaagaagaagaccacgaaagcattctacgagtacgctattcattggagatcagaagctgctaaggttagatcggctttagaagaagaacaaataaacaagtttttcgtccgggctcaagacccgcagtactatgaaaggatgatgttgattgagagctagaaattttccgacatcatcaatcaaggggaaaggatcgaggaaggcatcaaaagtggtatggttacaacctttgatgcttttcaagctactaataaggctttatagtctatcggtacgtccaagaaaagggacataggtgccataatggttgcacaaagagccaaatccgctatcaaataccaagcctatccgatacctccactcacatatcagcctaccctgaattaccaagcaccctcaccctcttaccaaactctaccgcccacttatcaatcatccccacctcctacatatcaacctacttcacccagatattcccaacccgcacatgtctaccaagcctacaatgctcagccatcccactatcaatcacctcccacacgttaaaacctttcaagacctcgaccaaattttgaccacagaccccccaaatagtataccgccattgctgagccaattgaccatctatacgaaaggctcaaagctcctggttatatcacccctatacattctataacccctgaaaacccttctcaatgggtcaatccaaataaatcctatgcataccattccagcataaaaggcataccattgatgaatgccgctctttgaaagtcaagatccagactttgattgataacaagagaagtgtggaaaaggagcctactctgaatgttgtcaacaaccctctatcgaaccataagggtggaggtgttcccatgattgaaatagaggataaaggatcgatcggtttaatcacagaaggtgacgaaccaaaaaagccaatagtcacccttaatcagattgtagtccatactcaaccttctagggatgccaaggtaaacatgtctgtaccacttgagtttgaagcaccaccccctgcaaagacaccaacaccaattgaggtcgagtttgggtctccatcaaacgcacccgcactgtttgaagttgcggttttaccctccaacatacatgatccattcggattataggtgcccattccagtagaaatgtcggccgtaacaccgttccatacaaatgccataccttgggattacacaaccgaggcaagaaggaaagggaaagctaatttcggggaaacagttgcggcacatggtttgacaagaaccagcagggtttatactccggagcatttagctgagtcgagtatgtaggcctttggtcggccgaccatcactaaaaccgggctcgatgatctctggagaaagatacaagacaagtaatactcagtcattgatcagctgaacaaaacactggcacatatttctatcctagctttgctgccaagttccgatgcatataagaagatgctgagtgaggcatatgtaccaagcaaaatcaccggaggagaaatgaaaaacatggtatggaaggtattggaaagtcacaagatcacttttcatgaagatgagctgccaccagaagggttgagtcacaataaagcattgcacatcatcgtgcaatgcgaagattattttatcactaggatcctgattgatggaggttccaaccttaatatttttctgttggtaacactcagaacattgggaaaggggctacatgagatcaaggacgaggccatcaacgtcaaagcttttgacggttcccaaaggtccactattggggaaattagcttgtacttgcaaatggggcctacttggtttaatgtcgatttccaagtaatatatgtgccgacatcttacaacttgttgttgggacggccgtggattcatggtgctggggctgtagcatcaacactacatcaggtagtgaagtttgagtggaatcaccaagaggtgatcattcacgacaacggtagcaatcccatatacagtcgccaaaccatcccagcaatcgaagaaaaaagaaacgtaggcggggaaacctatcaccacatcgagcgagtcaacgccgctgataaagacaaatggcgagacaacaaaattgaaagcatattgaactggagtggatatgaacctagcatgggacttggcaagaacctccaaggaatcgccaagcctatcaaactaaagaaatatggcatcactttctgtctgggatacgagtatacttgggaggaattcaacaactggtctccaccatggcgtgggccatactacccgctgtagtagccaataccacatttggagcagactttccagccggccgatgttatctatggattggatgaagaagaagcactaaaaacagtgaggaatttgttcctaaaagacgatgatatggattgttgtgttgttctcgaggaggagggggaggaaggtccttccatacaggccgtaagtcgaggagcatgccttaacaattggaccatcagaaccaccagagcccggaaagcctcggggtaacaaggctgaaaaaagcatcatgctctatcttttatttttactatttgattttcctttcgcattttgaattttcgcaataagatcttccaatgttcaaaacagttatgaaatttatcaaagcatttcggtttcattaaaaatcttactattattatttcttctcattactttatttatacagcattactattacctatcttgatgaaccaatgactgtgacattaaaggagataacgaaacaaacggacatagattcagaggaagatgatataccagaagagattgttaaagaagttgagaactttgagaacaagccgaagtacaacctggatgagactgagattttattaacctgggagatgcagaaaatatcaaagaaacacgaatcaacatttacttatcaccgtcagaagaggaagagtacacagaatttctaagagaacacgaggacatattcgcttggtcaaatgatgacatgactggtctgagtacatctattatggcccacaaacttccaactaatccgacatatccaccggtaaaacagaagctcagaaagttcaagcctgatatgagtccgaagatcaaagaagaagtcactaagcaggtcaaagctaatgttctcagggtagtagaatatccgacatagttagccaatattgtgccggttcctaagaaggatgggaaggtcagagtgtgtgtcgactatagggatctcaatcgggctagtccaaaggacgacttcccctagttgaacatacacatcctgatcgacaattgcgccaagcatgagttgcaatcatttgtagattgtttcgctgaatatcaacagatcttgatggacgaagaagatgcagagaaaacaactttcattatgccatgggggatgtactgctacaagatgatgccattcgggttgaagaatgtaggggtagcctacatgagggccataactactattttctatgatatgatacataaagagattgaggcgtatgtagatgatgtcatcataaagtccaagaaatccactgatcacatggaagatttgaggaagttcttcaacagactgagaaggtacaacctgaaactgaatcccgcgaaatgtgcatttggggttcctgccagaaaactacttgggttcattgtgagttgccgagggatagaactggatccatcaaaggtcaaagatattcaagaactgccactgccaaagaacaagaaggacgtaataagtttcttagggagactcaactacatcagccggttcatagcacaatctactatcatctgtgagccaatcgttaagatgttgaaaaaggacaccgctaccgaatggattgatgactgccaaaaggccttcgatagaatcaagaagtacttgttaacaccacctgttttggttcctcccgagctgggtaaacctctaatactctacctcgcattattggatggagcgttcggttgtgttctaggtcagcatgatgaaatagggaggaaggaacaagccatctattaccgcagtaagaagttcatcctgtacgaggcttgatattctctgttagagtgcaacctgttgtgctttgacttgggtagctcagaagttgaggcactacctctgtgccaatacttcatatctcatatcaaggatggatcccttgaagtacatctttcagaagcccatgcccactggcaagctagccaagtggcaaatcctgttgagttaatttgacattgtctatgtgacttagaaagcagtcaaaggataggcactagcagatcaccttgctgaaaatcccgtggacggagaatacgaacccttgaaaacatattttcctgatgaagagttatcattcataggataagatattgcagaatcctatgacggttggagaatgtttttcgatggagcaacaaattttaaaggagttggcataggagcggtcctagtatcagaaactggtcagcattatccagtgtctgccaaactcaggttcccctgcaccaacaatatggccaagtatgaagtctgcatcttagggctcaagatgtccattgaatgaacattcaagagttgctagtaattggatattcagacttgcttatacatcaggtccgagaagaatgagcaactaagaattccaaaatactcccttatctgcatcacgtacaggagttgagaatgaggttcacaaagaaaaagttccagcatgttcctagagtccagaatgagtttaccgatgcattggctaccctatcatgcatgatacatcatccaaataagagctttattaatcccattccggtaaagatccatgatcagccagcttattgtgctcatgttgaggaagaagcagacggaaagcattggtttcatgatatcaaggaatatttgacgaaaggagtatacctataacttgcaaatcctactaaaaaatgcacacttcggaggttgtccaacaatttctttcacagtagaggaatcctgtatagaaggactcctgatttaggattgctaagatgtgtcgacgcaaaagaaacatctaaactgctagaagaaatccatgctaggacctacggtccacatatgagtggctttgttttagcaaagaagatactccggactggttacttctggatgactatggatacagactgcatccaatacgtctgaaagtgtcaccgctgttagatacatcaagacaggataaaagtacctccaaataagcttaatgcaacaagcttgtcatggccgttcgccgcatggggaatggatgttattggaccaatcgaacccattgcatcaaatgggcacaagtttatcctagtagcaattgattatttcaccaaatgggctgaagcagcatcttacaggacagtgactaagaaagtcgtggcggatttcgtccgcgaccgtatcgtgtgtcggttcaaaattccagagtcagtcgttactgataatggctccaacctcaatagtgatttgatgaaatccattgtgaaaccttcaagatcaaacacaagaattctacagcctacagacctcagatgaacggagccgtagaggcctacaacaagaatatcaagaagatactaaggaaaataatagagaagcataagtagtggcacgagaagatatcatttgctttattggggtaccacaccactgtccgtacattaactggggcaacccctctatatgttggtttatggtatggaagcagtcattcccgctgaagtagaaatttcctccctaaggatcatatagaaagctgagctcgacgatgcagaatgagtgaagagtcgttgcgaacaactagctcttatagacggaaagagaatgaatgcagttttccatggtcagctttatcataacagaatgtccaaagccttcaacaaagagtcaagctaagacaattcacaccagggcagctggtattaaagaagtttttcccgtatcaagatgaagccaaagggaaattctctcccaactggcagggtccgtacatggttcaccggttctaataggaggaaccctcatatttgcagaaatggaaggggaagtttggacaaagccgatcaattcagacgcagtcaagcgatactatgtgtaacttttatgctttctttcatgatgtaatttgaactacgcctgacctgattcccgtttaagaggggatacataggcagccctatgggttcggtcacaattcaataaaattttcattttccctgctattggaaactagggcagaattttgaggaggaccctcaaaatttcaaagttgattccagccatttatcattaacagccatcagaagcagcaacccagtaaactggggcagaattttgagaaggacccacaaaattccggagcaagagaagttgcaatgtcttaaaccacgtcgcaatcgtcggttcatctaaacaaaactattcttaattatgtacttatgttatgcttttactagatcatgcatgtttattactaaaattgctttgtttagcaacgctaccccagtgatatatatagtatcgccgaatcaaagcctagcaggccaagaaaagctagcggggatacgaactaacctttccccctttaaaactcaagactttttctttggatgcaggcacttgagttgaaaaatcatcaaatatactatacactcactcacaaagttcagtaatagaactctccgaaccattgcgcttgctcgcaactactatccgcacacaacagtgtccccagcgggcacaatatccccagtaatcacgataccacaatccgcaatcagctaagaaaactctattgccatttgttattttacttcctgcataaggctaccattctaccttccgagactaagctctgtctccatttgcattttctgtattgcataaggctaccattctgccttccaagactaagctttgtctccatctgcattctttgcattgtataaggctaccattctgccttccgagactaagctctgcctccatctgcattccctgcattacataaggctaccattctaccttccgaggttaagctctacctgcatttgcatggctgaaagatcgccactttatttacagcttgcatggccgaaatattgccactttatttacatcttgcatcggctgaaagatcaccacttcatttacatcttgcatcggctgaaatattgtcactttatctacatcttgcatggctgagatatcgccacttcatttacatcctacatcggctgaaagatcgccacttcatttacttcttgtattgctaaaatattgccactttatttacatcttgcatgtcttaaatatcgccacttgatttacatcttgcatggctgaaatatccccaccttatttacgccttgcatcggctgaaatatcgccacttattgcatttcatgggctgaaagatcgccacctactgcattccatggctgaatgattgccatcttcacacttgcatggctaaaatattgccgctttattttacgtttgtatcgctgaaagatcgtcacttattgcatttcatgggctgaaagatcgacacctactacattccatgggctgaaagattgccaaaattgtccaaatgcatcattgtttggaggcaacattttcatagcccgagaacgccatgcctggcctgagggccccttttatcttttgcatatcattatttaaaggcgtcatagtttggaggaatcattctcatagcccgagagcatcatttaatggcctgcgaattccttatcatacacttcatggcccaggacgtcatggtttgaggatgtcatcctaaatgtccaaagacaacatttatggtccgacgggaacttgcatcacgtttaaatttccgcacaatatacacttgtattgcttatttgcaggtaaaccggcgagcaacgaccgtctcaacaggagcaatcccgctccagttcccgccgccctgttagattttaaccatccatcccaacccaaatatcgcgtccgttttgaaaaatctccatcgacatattccgccgacggatcctgaactacatatggattgatttctgtaacaccagagatatgtaggtagcataggagatagagttcggtcaaattcttcaaaccattccgttcgatcaaattagccatcatatcttcacccgacaactctttcaactttctcgggtaaagaggggcagctgttgatacccaatttttttcaatattttttatttgaaaaatacctttcaaaatagcatgtatatacatatataagtatgtcccaaggtcctattatttttttttaattttttaaagattttaaaatcaattttattgctctattttatcaagaaaaacccaataagtattcccaaaattggaattttcgtaattcatttattggattctcatatttatactaaaatatagctagtatgatttttgcacatttttacaaatttatctagtatttaaaaaaaatgctaaattacatgtaattgcaatattagcctactttaagattaaattgcatttataattacaaaattagctccagtatttttagtctaatatttatatattattaattaatttagtacctttaatttatttgcataaattattttactatttttataaaataaataaggaaaatggctatttaaatgttagcctgtttttacttcgattttggccagatttggcacctctaatccaactcaatttcaatttcaattgcccagcccaattccaaaattacccgacccacaacctttaaaaaataacttacacgaccctcctttaaatcccagccgttgatctaacagatcaacgactcatgttctcccttttctttttaatttgccaacagccccccaaccctaatcattttgtcaccagtagccgctttaaaaccctccactctctcaaactctctcgagtcttcttagaaccctagccgcctcttatcgcttccaccatgaaagccaccagaatccatggcttccaaggctatgggagtcttatacctacctcttgttgctcttacacacctgatctctgaagattcacggcttgaccttgaaggtttgtacccagacctctatggatccgaggtttcacggccatctccagccttgctccggcgtaccatggttgtttgagcccgatcctgacctctccgactcagatcagtgacttttcaaagcctttctcatttctaggtttcttctgaaaccctaacccttcgatgttttccgattcccttagatctgttcaggatccatgctttccttaaggtcttaaacattttcctgacttttctttcaaaaaactactttcaaaatctttcttttccgatctagggttttctgaaagtatttaagtgttttctaactttctttttccttttatgtgtatttgcttctactgggttcttgttttttcttctaccatgttcttacgtgcttcttctgctgtattttcctatactatgttctcatatgctcttctactatatgttttctctactgtgttctgatatgtttctcctactgtattttcttactaagttcttaagtttccttattaagttccttttactgagctctgtttaaagtttcttctaaaatttcttagcatgcttcttctactattcttatcagtcttctctattatgtttcgtattagcttcttctactctatttttctttgaattttgctactatgttttgcgtgttacatgatatcattgttttctcatgagtttctgctgctgaaagaaacatgcaggaggtttcatagaactgaaacctctgagcctttttcgattacatgccttctcatctatgtacttgattcaaggtgaaaaccctagaatttgggggttctgccaagtttgattatgtgatttaattgaactaggatttttattttagaacccctaactctttcagaacaacttcgagtctcggaacctagtttggacatccgtgtttgcatatgattctgacctttggctaaactcttctaaaactctttcttcactggatttttttattgatttttgcaatggcacaacattttcttccaactcaatgtgtttgtgtgctctttatatgtgatgaatctttctctaaaaaggctttcaactcgtgattgattcaaattccttctaaataggtatgattgattccctttccattgtttgctgattttccttaagataaaaaacctttcccatctttttgactcgattcattcatacaagatcattgacctttgatttactggctgctaattattttcttgccttgtttgtgcaaccgcgtattttagaaattttgtccttaaataacctttatgtatttacctttaattgcatgctgtgcacaaagtgcttattcatttttctttccttaaattgtttttacctatttgaatctgaatccattaattaagggaaatcttgtgtaattaattgacaatcagttccttgactattttcttaccttatttcttcatgattttcacactataaaagcataaccctttttcaaaaagaggacatcagaatccctctgaactcaaactctcttacaataactttctcttcttgtctgcattgtggcctgtttacaagacctactacttttctttgtttgttttctttgaaactaatatgtcctgatttaagcttcaacgctacaacaatgtgtttatttacagtctttgtatccatgtctactttactactttctatagagttcaacatttaaattagtatgcttatgtcctactacctgtttctgctatgaatcatcgcccctatttccctttatgtgctttgagttacagtttaaagcatggcaatatgcaagttattgtctatggattgaacttgatcccttagaggatcctaacctctaaacaatgtgttctaacaggcttatgggtgtgccagcatttcccattgcagggtatgcccactagcctgtcttttcctatttaccacctccccattccctatacccctatgtgtattaatgtaaactgtttctcttcccctttttcagaattctgcacttgcaccctctcttagtctataagttctgccccccttttgtgagccttgccttgggaccttgactatgaacttggataccatgtctctaagaatttctgcattctcataccttgtgtataggaatcttgcattaccatatagataccatgcctatagattatttctgaatttctgcatatcatatagatatcccgcctatagaaatttctgaatttctgcgtatcatatagatatcctgcctataggttctttctgaatcttgcatatgcattcctcattaggcaaacatgtttgtaggtcttaataatcaaccgcaattagatatcatgttcataggtcttaaacgaaattcagcaactagatgctatgcctataggatttatgcactttgctatgtctatgaaagtgtttaaatcaacaacacctagaaagcatgcctataggagctattaatcaagtctgaactatttcactcacttataagtctaaaaccggcaataatgatgcattaccagttgcagaacttatgttcttttgctaaaactcacccttctttaataactaacaccttctcttaagtaagtatgtaatcatctcatatcccttgttcttgcagtatatagatatcacgcctatagggttttcatctaacacttaggcaagccatagggtaaatgattataaattgaatctgtttttattaacaacaacaatcaggcagtcctgattcgggtttcttatctgaattatgtgataaatcaatctgcctcaacccttaagtttaatcaggccctaaacagtatgtgtaagtcatgctatttgcttgctttctttgtttaaaggaggtctgtttgagccttttcatttgtttatatgcttccccatacttgccatatatgttttgtttgtcgccttagtatttttaccttttgaaaccacaagtaagaccaatatccctcccctttaggattagtagtcccaaatgcctccgggactgataggattggggcgggtaatagcatgcaataagtaaatgagaccattccgcgctttaataccttaaacagggcgggaagggtagatatggatatgataaccacgcggtaacatcacgtgtagcccttcactgaggagtgataccagatgttgtgtggggtgatccatattattaataaacctaggacccactcctttcttttgtttcttccttttaaaccttttaaactgtttcttcaaaatcaactcttttaattttcttacttgtaactctcatgtgcaaaatcccctcttatttgaagtcttattcgcctacgtgttgtttgcaattaaagtcacaataattgtccggccgggaaccacactagtgcatcctgaggggtgcctaatacattccacttgggataatttcaagcccttacccaatctctggttgttcaaatcaaacctttcttagtgtcctaatgcactcaaatcattaggtggcgactcttcaattcaaacccaattcccgaaagggaacgagttgtccacccaaatgtcataaacccgatttcgcgagaaaaagggggcgaaacagcgtggcgactctgctggggacttttaggtttttaccatttcagactattattgtgaatttatgcttctttatgtgcaattatatgtttatttcttttaagcattcaatttccttttcaattgcaaaagtgacttgtctttttgtttcttccctttattactttcctttactgctttcctttactaccgctttaagttatgtaaaactgttgtatttactactttcctaacgtgcaaatatgtgacaatctattttaattattgcataattatgctcaacatcatattccactcgtgccaaacaaaataccatagcaacgcttataatgagtggttgtgctcttcggtattatcacccttaaatacgaaaaaggcgtatttgcggtaaaaccagtcgatcaatgctgtagtcgacggttctgtacctttctcccttaagttgtccgcccaaaggtactagtctaaaaccccatagaaaccttactctatttaactgtgcatgtatcatggtcaaacctagccgggtcagttatgttgtccgcataatgatcctttaagatagacttgtccaaagtccactaggtttccctaaaacccaaacggacatcatcacgttctatgcatttatttggagaactagatgcgtttatgctaattgttgatattaaatagtcgagtctggtaggggtaatggcctaacccttttgttttgctgaaaatgaggcacgaggtgcccagttttggtatggttagcataccctcactcttgctagactggtggaggagtcttccatcaaataaccaaatcaacgagtggaaagagagggccaccaaagctagtgaaaagctgaaatatctagagtacagtctactgaaattggaaggaaaagtgaggaagagagtcaccgactaccagagcgccgaggtaaatgaaggagaacacctagcaaaggtatgattactggtgaacctatgcgaaccggaggatctgatcaacgagagcattcaacatgaggaaggtccttccgggacaaagtagataggagcttgttcttttgctttaagaaatgtaataaggcccatggccattagtgattttcatttcttgtttatttagtgtagatttgggattcgtctactttttatcaataaaatgaggcatttagcattctaagttctccaaatcaacttgtcactaggactacctcgagcacaaagaggttcccaaataggacacgatttacattcttgcactatgtatttaaatatcgcaacattttcttataatcctcactgacttgttacttttttgtttttactttttatttatttatttccgtccccaaaggttagttcgtgcattctggcattgtcatcatattccacatgatcaaagggccctccacccactcctcctcctagtcctctcagaagtaggaacaaagaaaagatggaagatttgaacaacaccagaaaggaaaactcaactgaacgggtagaggtcactcatggtgctcaggtctccaaagaaaatgcgtcccaactcgagcagaaactgttgaaatttcaggaagaacttgatcaggttcggaatctggcaaacttgtcattttccctcagcactccagctatcaattttccaaatgctcagaactccacagctccacaaaacatccaaaaccacaaaaccatcctgctcctcaccaccactgcaatacttgccacacatccagcaatactccactgctcatccctgaacctttgaattccagaaatgacaatttccacgctcatcataacaccaccatctacgtggaaaccatgccacactttacctaaccaatctcaagcacacccgagtttgatgataaagactcactcatcaggaacctggctacagaactcaagaaattgaatagtcgaattcagggtgtcgaaggaagtaaggggattaaaagggttgaactacgaagatctttgcatacaaccggatgtcgaactgccttaggggtacaaacctcctaagtttgagatgtttgatagtacaggggatctgagagtccacttgacaacatactatgccaagctggtcggagtagggaaagacgaaaggattcgcatgaagcttttcatgaggagtctgagaggagatgctctgtcttggtacattatccaagacccaaagaaatggtcgaactgggtgagtatgacatccgactttatggacaggttcaggttcaacatagaaaatgcgccagatgtgttctacatctagaatttaaagaagaatcccatggaagcattctatgagtacgctactcgttggagatcagaagctgctaaggtcagaccggctttagaagaagaataaataaaaaagtttttcgtccgggctcatgacccgtaatactatgaaaggctgatgttgattgagagacagaaattttccaacatcatcaagctaggggaaaggatcgaggaagtcatcaaaaatggtatggttacaacctttgaagctttgcaagctaccaataaggctttactgtctggcggtacgtacaagaaaagagacgtaggtgccataatagttgcacaaagagccaaatcccctatcaaataccaagcctatccgatacctccactcacatatcagcctaccccgaattaccaagcaccctcaccctctcaccaaactctactgcccacttatcaatcatccccacctcctacatatcaacctacttcacccagatattcccaacccgcacttgtttaccaagcctacaatttttagccatcccactatcaatcacctcccacacgtcaaaacttttcaagaccttgaccaaattttgaccgcagacccccaaatagtataccgccattgctgagccaactgaccagctataggaaaggctcaaagctcttggttatgtcacccctatcccttctataacccctgaaaacccttcttaatgggtcaatccaaataaatcttgtgcataccattctagcatgaaaggcataccattgatgaatgccgctctttgaaagacaagatccagactttgattgataaaaatatcattgtggcaaaggagcctactccgaatgtcggcaacaaccctatgtcggaccataagggtggaggtgttcacatgattgaaatagaggatgattgggatcccaaaggatcgatcggtttaatcacagaaggtgacgaaccaaaaacaccaatagtcacccttaattagattgtagtccatactcagccttctagggatgccgaggtaaacatgtatgtaccacttgagtttgaagcaccaccccctgcaaagatgccaacaccaattgaggtcgagtttgggtctccagcaaacgcacctgcaccatttgaagttgcggttttaccctccaaaatacatgctccatttagagtaaaggtgcccattccagtatcaatgtcagccgtaacaccgttccatacaaatgccataccttgggattacacaaccgaggagagaaggaaagggaaaaccaattttcgggaaacagttgcggcacaaggtatgacaagaacctgcagggtttatactccggagcatttagctgagtcgagtaagcaggcctctagttggccgaccatcactaaaaccaggcccgatgatctctggagaaagatacaagtcaaggaatactcagtcattgatcagctgaacaaaacactggcatagatttctatcctagctttgctgcaaagttccgatgcacataagaatgccttgttgaaggtgctgagtgaggcatatgtaccaagcaaaatcaccggaggagaaatggaaaacatggtagggcaggtattggaaagtcacaagatcacttttcatgaagatgagctacaaccagaagggttgagacacaacaaagcgttgcacatcaccatgcaatgcgaagattattttatcactaggatcctgattgatgaagggtccagccttaatatttttctgttggtaacacttagaacattgcgaaaggggctacatgagatcaagaacaggtccatcaacgttaaagctttcgatggttcccaaaggtccactattggggaaattagcttgtacttgcaaatggggcctacttgtttcgatgtcgacttccaactgatagatgtgacggcatcttacaacttgctattgggacgaccgtggattcatgccgctggggctgtagcatcaacactacatcaggcagtgaagtttgagtggaatccccaagagatgatcattcacgtcgacagttgcaatcccatatacagtcaccaaaccatcctagcgatcggaggaagaagaaaggtaggcgaggaaacctatcaccacatcgacgagtcaacaccgttgacaaagacaaatggtgggacaacaaaattgaaagcatgttgaactggagcggatatgaacttggcaagagacttggcaagaacctccaaggaatcgccaagcctatcaaacttaagaaacatggcaccactttcggtctggtgtacgagtatacttgggaggaattcaacaactggtctccaccatggcgcgtgccatactacccgctggagtagccaataccacatttggagcagactttccagccggccgatgttatctatgggtcggatgaagtagaagcactagcagcagtgaggaatttgttcctagaagatgatgatatggactgttgtgttgttctcgaggaggagggggaggaaggcccttccacacaggccataagtcgaggagcatgccttaacaattgcaccatcggaaccaacacagcccggaaagcctcggggtagcaaggctgaacaaagcattatgcactatcttttatttttactatttgatattcctttcgcattttgaaatttcgcaataagatcttccaatgttcaaaacaattatgaaatttttcaaagcatttcggtttccttacaaatcttactcttattatttcctctcattactttatttatacaacattactattacctatcttgatgaaccaatggctgtgacatgcaatgagactacgcaacaaacagacataaattcaaaaaaagatgatataccagaagagattgttaaagaagtcgagaactttgagaacaggccgaagtccaacctggacgagattgagattgttaacttgggagatgcagaaaatgtaaaagaaacatgaatcatcattcacttatcaccgtcagaaaaggaagagtatacaaaatttctaagagaacatgaggacatattcgcttggttatatgatgacataactggtctgagtacatctattatggcccacaaaatgccaactgatccgacatgtccaccggtaaagcagaagctcaaaaagttcaaacctgatatgagttcgaagatcaaagaagaagtcactaagcaggtcaaagctaaggtctcagggtagtagaatatccgacatgtttagccaatattgtgccagtgcctaagaaagatgggaaggtcagagtctatgtcgactaccgggatctcaatcgggctagtccaaaggacgacttccccttgctaaacatacacatcctaatcgacaattgcgccaagcatgagttgcaatcatttgtagattgtttcgctggatatcatcatatttggatggacgaagaatatgcagagaaaatggctttcattacgccgtggggatgtactgctacaagatgattccattcgggttgaagaatgcaggggtcgcctatataagggccatgactactattttccatgatatgatacacaaggagattgaggcgtatgtagatgatttcatcataaagtccaagaaagccactgaacacatggaatatttgaggaagttcttcaacagactgagaaggtacaacctgaaactgaatcccgcaaaatgtgcatttggggttcatgccggaaaactacttgggttcattgtgagttgccgagggatagaactggatccatcaaaggtgaaagctattcaagaactgccaccgccaaagaacaagaaggatgtaatgagcttcttggggagactcaactacatcagtcggttcatagcacaatctactgtcatctgtgagccaatcattaagatgttgaaaaaggacgctgctatcgaatggactgatgactgccaaaaggccttcaacagaatcaagaagtattttgtcaacaccaccaattttggttctgctcgagctgggtaaacctctaatactctacctcgcagtattggatggagtgttcagttgcgttctaggtcagcatgatgaaacaaagagaaaggagcaggccatctattacctcattaagaaattcaccctgtacgaggatcgatattctctgttagagtgcacctgttgtgctttgacttgggtagctcagaagttgaggtactacctctgtgtcaatattacatatctcatatcaaggatgaatcccttgaagtacatctttcagaagcccatggccactggaaagctagccaagtggcaaatcctgttgagttaatttgacattgtctacgtgactcagaaagcagtcaaaggacagacactagcagatcaccttgctgaaaatcccgtggacgaagaatacgaacccctgaaaacatattttcctgatgaagaggtaatcattcataggagaagatattgtagaatcctatgacggttggagaatgtttttcgatggagcaacaaatttcaaaggagttggcataggagcggtcctagtatcagaaaccggtcagcattatctagtgtctgccaaactcaggttcccctacaccaacaatatggccgagtatgaagtctgcatcttagggctcaagatggacattgaatgaacattcaagagttgctagtaattggagattcagacttgcttatacattaggtccgagaagaatgagcaactaagaattccaaaatactcccttatctgcatcacgtacaggagttgagaaagaggttcacaaagacaaagttccagcatgttcctcgagtctagaatgagtttgccgatgcattggctaccctatcatccatgatacatcatccaaataaagctttatttatcccattccagtaaagatccatgatcaaccagcttattgtgctcatgttgaggaagaagcagacggaaagccttggtttcatgatatcaaggaatatttgacgaaaggagtatacctagaacttgcaaatcctactcagaaacgcacactttggaggttgtccaacaatttcttttacagtagaggaatcctgtatagaaggactcctgatttaggattgctaagatgtgtcgacgcaaaagaaacatctaaactgctagaagaaatccatgctgggacctacggtccacatatgaatggctttgttttagcaaataagatactccagactggttacttctggatgactatgaagacggactgcatccaatacgtccgaaagtgtcaccgctgtcagatacatgcagacagggtaaaagtgccactaaatgagcttaatgcgacaagctcgccgtggccgttcgccgcatggggaatggatgttattggactaatcaaacctaccgcatcaaacaagcaaaagtttatcctagtagcaattgattatttcaccaaatgggttgaagtagcatcttacggggcagtgactaagaaagtcgtggcggattacgtccgcaaccgtatcgtgtgtcggttcggaattatagagtcaatcattactgataatggctccgacctcaacagatatttgatgaaatacatgggtgaaaccttcaagatcaaacacaaaaattctacagcctacagaccttagatgaacggagccgtagaggccgccaacaagaatatcaagaagatactaaggaaaatgatagagaagcataatcaatggtacgagaagatatcatttgctttattggggtaccgcaccactatccgcacatcaactggggcaaccccctacatgttggtttatggtacagaagcagtcattcccgccgaagtagaaattccctccctaaggatcatataggaagctgagctcgacgatatagaatgggcgaagagtcattgcgaacagctagatcttatagacggaaatagaatggatgtagtttgccattgtcagctttatcataacagaatgtccagagccttcaacaaaagagtcaagccaagacatttcacaccagtgcagctggtattaaagaagattttcccgcatcaagatgaatccaaaaggaaattctctcctaactggaagggtctgtacatagttcaccggttctaataggaggagccctcatacttgcagaaatggacggggaagtttggccaaagccgatcaattcagatgtagtcaagcgatactatgtgtaacctttatgctttctttcattatgtaatttgaactacgcctgacttgattcccgtttaagaggggatacgtaggaaaacctatgggttcggtcacaattcaataaaattttcatttcccccgctattggaaactggggcagaattttgaggaggaccctcaaaattccaaagtcgattccagccatttatcattaataaccgtcagaagtagcaacccagtaaacttgggcagaattttgagaaggaccctcaaaattccggagcaagagaagttgcaatgtcttaaaccacgtcgcagtcatcggttcatctaaacaaaactattcttagttatgtacttatgttttgcttttactagatcatgcatgtttattactaaaattaccttgtttagcaatgctaccccagtgatatatacaatatctccaaatcaaagccgagcaggccaagcaaagtcagcggggatacgaactaacctttccccctttaaaactcaagactttttctttggatgaaggcacttgagttgcaaaatcatcaaatatactatacactcactcacaaagttcattaatagcactctctgaaccattgcgcttgctcgcaactactatcggcacaaaatagtgtccccagcgagcacaatatccctagcaatcatgataccacaatccgttatcagctaagaaaactctattgccatttgttattttacttcctgcataaggctaccattctaccttccgagactaagctctatctccatttgcattttctgcattgcataaggctaccattctgccttccgagactaagctctgtctccagctgcattctctgcattgcataaggctaccattctgctttccgagactaagctctacgtccatctgcattccctgcattacataagactaccattctaccttcctaagttaagctctacctgcatctgcatggctgaaagatcgccactttatttacatcttgcatggccaaaatattgccactttatttacatcttgcatcggctgaaagatcgccacttcatttacatcttgcatcggctgaaagattgccacttcatctacatcttgcatggctgaaatatcgccacttcatttacatcttgcatcggctaaaagatcgccacttcatttacttcttgcatggatgaaatatcgccactttatttacatcttgcatggctgaaatatcttcactttatttacatcttgcatggctcaaatatcgccaccttattttcgtcttgcatcggctgaaatatcgccacttcatttacacttgcatggctgaaagattgccactttttgcatttcatgggctgaaagatcgccacctactacatttcatggctgaaagatcgtcatcttcacacttgcatggctaaaatattgccgctttattttacgtttgtatggttgaaagatcgtcacttattgcatttcatgggctgaaagatcgccacctaaaacattccatgggcttaaagatcgccaaaattttccaaaggcatcattgtttggaggcaccattttcatagcccgagaataccatgccgtggcctgaggaccccttttatcttttgcatatcattattcaaaggaatcatagttcgaaggcatcattctcatagctcgagagcatcatttcatggcctgtgaatcccttatcatacgcttcatagcccaggacgtcatggtttgaggacgtcatcctaaacgtccaaagacaacattcatggtccgacgggaacttgcatcaagtttaaatttccgtacaatatacacttgtattgcttatttgcaggtaaaccggcgagcaacaaccgtatcaacaggagcaatcccgctccagttcctacctccatgttagactttaaccatccatcccaacccaaatatcgcgtccgtcttgaaaaatctccatcagaatattccgccgacggatcttgaactacatatggcctgattcctgtaataccagagatatgtaggtagagtaggagctagagctcggtcaaattcttccaaccattccgttcggtcaaattggtcatcatatcttcactcaacaactctttcatccttctcgggtaaagaggagcagctgttgatacacaattttttcctatatattttatttgcaaaatacctttcaaaatagcatgtatatacatatataagtatgtcccaaggtcctattatttttctcaattttttaaagattttaaaatcaattttattgccctattttatcaagaaaaacccaataagtgttcccaaaattggcattttcataattcatttattggattctcatatttatactaaatagtatgatttttgcacatttttacaaatttatttagtattttaaaaaatagctaaattgcatataattgcaatattagcctactttaagattaaattgcgtttataattacaaaattagctccaatatttttagtctaatatttatatattattaattaatttagtacctttaatttatttacagaaattattttactattttttataaaataaataagggaaaatggttatttaaatgttagcctgtttttacttcgattttggcctgatttggcacccctaatccgacccaatttcaatttcaattgcccagcccaattccaaaattatccgacccacaacctttaaaaaataacccacacgaccctcttttaaatcctagtcgttgatctaatagatcaacgactcatgttctccctttcctttttaatttgccaacaacccccaaccctaatcattttgtcaccagtagccgccttggaaccctccactctctcaaactctctcgagtcttcttagaaccctagccgcctcttaccgcttccaccctgaaagccaccagaatctatggcttccagggctattagagtcttataccttcctcctgttgctcttacacacctgatctctgaagattcaaggcctaaccttgaaggtttgtacccagacctctgtcgattcgaggttccacggccatctccagccttgctccggcgtaccatggttgtttgagcctgatcctaacctctctgactcagatcaatgacttttcaaagcctttctcatttctagggttcttctgaaaccctaacccttcgaggttttccgattcccttagatccgttccggatccatgctttccttaaggccttaaacgttttcctgacttttctttcaaaaaactactttcaaaatctttcttttccgatctagggttttctgaaagtgtttaagtgttttctaactttcttttttcttttatgtgtattttcttctaccgggttcttgtattttcttctaccatgttcttacgtgcttcttctgctatgtttccatatactatgttctcatatgctcttctactgtatgatttctctactatgttcttatatgtttctcctactgtattttcttactaagttcttaagtttccttattaagttccttttactgagctctgtataaagtttcttctaaaatttcttagcattcttcttctactgttcttatcagtcttgtctattatgtttcgtattagcttcttctactctatttttctttgaattctgctactatgttttgcgtgttacttgatatcattgttttctcatgagtttctgctgctgaaagaaacatgcaagaggtttcagttgaaacctctgagccttttttgattacgtgccttctaatctctgtacttgattcaaggtggaaaccctagaattcgggggttctgccaagtttaattatgtgatttaattgaactagggtttttattttagaatccctaaatctttcggaccaactttgagtctctgaaccgagtttagacatccgtgattgcatataattctgatctttggctaaactcttctaaaaactctttcttcactggatttttctattaatttattcattggcacaatattttcttccaactcaacgtgtttgtgtgctctttatatgtgatgaatcttcctctaaaaagtctttaaactcttgattgattcaaattccttctaaataggtctgtttgattccctttccattgtttgttgatttgccttaagttaataaacctttcccatctttttgactcggttcattcatacaagattcctgacctttgatttactggctgttaattgattttcttgccttgtttgtgcaaccgcatatttcaaaaattctgtccttaaataactttttgtatttgcccttaattgcatgttgtgcacaaagtgcttagtcatttttctttccttaaattgtttttacctgtttgaatctgaatcccttaattaagggaagtcttgtgtaattgattgacaatcagttccttgactattttcttaccttatttcttcatgattttcacactataaaaggcataaccctttttcaaaaagaggacatcagaatccctctgaactcaaactctcttacaataactttctcttcttgtctgcattgtggcctgtttacaagacctactacttttctttttttgttttctttgaaactaatatgtcctgatataagcttcagcgctacaacaatgtgtttattaacagtctttgtatccatgtctactttactactttctgtagagttcaacatttaaattagtattcttatgtcctactgcctgtttctgctattaatcatcgctccctacttccctttatgtgctttgagttatagtttaaaacatggcaatatgcatgttattttctatgtattgaacttgatcccttagaggatcctaatctctaaacaatgtgttctaacaggcttatgggtgttccaacatttcccattgctggatatgcccactagcttgtctttgcctatttaccacctcccctttccaatgtgtattaatgtaaactgtttcccttcccctttccccttttcagaattctgcacttgcaccctctcttagtctctaagttctgcccccctcttgtgagccttgtcttgggaccttgagttccctctgaacttggacacttgagggctgacccttctacactgtaccatgtcttcatctataatgtatttgggtgtgagcattgcctgtagtccatatgagactcttagggaactctgacacatccaaatgggagaaaggctttgaaataagatctcttggagttggtttacttcatacttcagacaggaagtctaaatcaggctctccttggttgtactttttctgattgtattttttctttactttactttttctgggctataataactttgtaataaaactctaggaatggatagtgaaaaaggaggggtaactatgtatgtaaaaaggggtagataacctgcctataagagtttatgaattccagcattctgagataaacaccatgtctataaaaatcttgcattctcatatagataccatgtctctaagaatttttgcattctcataccatgtctataagaatcttgcattaccatatagataccatgcctataggttatttctgaatttctgcatatcatatagatatcctgcctataggaatttctgaatttctgcatatcatatagatatcctacctataggttctaaattcaacacctagatgccatgcatataggatttctacactttgctatgtctatgaaagtgtttaaatcaacaacgcgtataaagcatgcctatatgggctattaatcaagtctgaactatttcactcgcttataagtccaaaaccggcaataatgatgcattacctgttgcagaacttatggtattttgttaaaactcacccttctttaataactaacaccttctgttaaatcagtatgtaatcatctcatatcccttgttcctgaagtctatagatatcacgcctatagggttttcgtctaacacttaggcaagacatagggtaaaagtttataaattgaatttgttgtttttaactacaactagcaggcaggcctgattcagatttcttatctgaattatgtgataaatcagtctacctcaacctttaagtttaattaggctctaaacagtatgtgtaagtcatgctatttgcttgctttctttgtttaaaggaggtctgtttgagccttttcatttgtttatatgcttccctatactttccatatatattttgtttgtcgccttagtatttttactttttgaaaccacaagtgagcccaatatccctcccctttaggattagtagtcccaaatacctccaggactgataggattggggtgggtaatagcatgcaataagtaaacgagaccatttcgcgctttaataccttaaacagggcggggagggtagatataggtatgatgaccatgcggtaacatcacttgtagaccctcactgaggagtgattactggatgttatgtggggtgatccatattattaataaacataggactccccccctttcctttgtttcttccttttaaacctttttaaatgtttcttcaaaataaactcttttagttttcttacttgtaaccctcatgtgcaaaatcccctattatttgaagtcttattcgcctacgtgttgtttgcgcttaaagtcacaataattgtctggccgggaaccacactagtgcatcctgaggggtgcctaacaccttccccttgagataatttcaagcccttacgcaatctctggttgttaaaataaaacctttcttagtgtcctaatgcacttaaatcattaggtggaaactcttcaattcaaacctaattcccgaaaggtaacgaattatcctcccaaatgtcataaacccgatttcgtgagaaaaagggggtgcgacaagttaaataagagagagtgccaagggggagacaaaagaaaagaatttgaatttaggaataaccttatgagaacaagggcactgaggtatgtaactaaggatgtttataggcgagcaagaacattaaaaattcctttaggtatacgatgtaataagcttgcatcttttcagtagtcagagggtctcccctaagtactacaactaaagattacatgaggaaataagagagaaggtttcaacctaagcatagtgatctgaagaacaaatgatcttggagcaacagtcttactagaacattgtatgcactccataagaaagtggcacctatcgtagcttatgaatgggaagtagaattcaaaagtgatatttgagatcatatgagttacatgaagttctagtattcttgggtaatgagatatgccaagtattcacacaatgagtggcagaaagaccaggaaaagtaatttcttacatttaaagaaaactaagaaggcacaaaatgaattattctatcaacgacctccagttaattatgttatgaacgcacttaagttttaggagtgttatccatgcaacatatatgctgacattcatacaattataggagactttggtatacgttaagaaaaagaattgagtccacatcacagataaaggactgagttgctagaagattataccatggatgttacataacatccacaaaaatctaatgtaatagctaataccttgagcgattggaagatagcttaagcctacacaaaggctgagagagaagaggaagctcgaaagttacaatagctaagtaaatcaggggtccgattattagacccagatggttatagaaattgtgactcaaaacattgcagaatctctattaatagcagagttacaagaaagatagtacaatgaccatattctgtaacatctctacgataaatccagttagaagactactaacctcatatgaagtcaatataaagtgcccatctgattgtttatgcatcataggtgcatgtattatagtagcgatttaaggtgtggacgtgaatttcacccatgtggaagggaggtaatgaaagtgacagaagatacaatgcaaaatttaaagctaagaaaggtaaaggtaaaaaaaatacgagatacaagccagacttcagatagaggcctagaagcgctgtgatttagtatctataaatgatagtagtgtcttcagtagcatatcattagcctatggtttctaggtaccgaggtctagttaagagggtaaagaggacgtgatgtcttccttgaggttccataataacataaggaaatcaatggtgcttgcaagttaaaagaaggttgcgagtagtataaatagatatgtgtaggtcgcaagctaaagtgtggtagagagacaaggtcttagttatataggagtaaggataaaaaaaggtgagtgaaaaggggacaagaatagtaaggcctcaggatttagcccatcaaaacaagacgtctgatgattttcgtaagttatagaaagctaagtagagcctgaatgaactcggatgagtctaagactaggatcatttagaaaagatgaaatgccacctttgtgtcgacgccccctgtttccctcctaaaagaaggcgaaatggggtttacgacattatgggcaaaacaactcttattcccttttgaggaatcgggttatggaatttgaagagtcaccacctaatgactatagtgcattaggaccttttagagaaaagaagaatattttttggaagaaaaccagagttcgggtaagggcttgagattatctcgaggggaaggtgttaggcacccctcaagatccactagtgtggttcccggccgtacttagttgtgactttaagaagagtaggagtagacaagcaaagtttgcacataagaaatataaacaagttgacaattttgaaagaagaaagacacaagtgatttttttttttggaaaaaaaaaggaaagtttagtttgaggaaaacgttaatttaaatgaaggaaaagcaaagaaaagggttctaggtttaaatacaatatggatcaccttggtgcaatacccaacagtcattctcacacgagatattagtgcaccggtcatcatatccatattctacccttcccaccccgttaaggtattaaacgcaattagtctcatttacttattgcatgctaatacccgtcccaacctatcagtcccagggtattaggacttctaatcctaagagggaagaaagggatggggcctttatggagtgtaaaggataaaattctagtttcgacattccaaaacaaatatcaaataaaaggatgagtaaacaagcaaacaaggctcaaataaaccccttaaatcagacaacacttaatttagtatgtcttagcatatactgatttggtcttaatttaaaaactaagcggcgagcggactggttcaacacatatatttagacagaaagtctgcattaggcaactcggatccaattgtcagaaattgaagtattttaagcgagtaaaaaaaagcactattttcagaaaggacctaacgcagaatagtttaagacagaaggttgaaaatttgcagaggttcagagatgacatgaaaatcagtagtattgtttaaggataaaacgagttcgagctgcagaacttattaaaaatgataaaatacagaaaagtgatatgtaactgagttggaaatcattcattgaactaccagaaaaggcagtaagtttcggaaagcatgcaagtttaccagaagattaggttttagaaagagttgcactaatctgggaagaggctcaatggttcggagaaccactagttttttatccgttagtcaatgaaattgttactgcttttagacgagtgaggcaagtttgaaaaaaacttcatatagacatgatctctacgagtcatttgttttaaaccatgttaacaaacttgtaaatagatgctgatttgattatccctaaaaatttgcctaatatcatgaacatgcacattcctataggcatgatatttatatgcaagattgcagaaagttaaatattgtctcctataggcatgatttctatgtgattggatcaaaaacattaaaaagaattaaaaccctaaagcatggtttctaccctttgatgcaggaaagtaaaatccctcccacacctttttgctagattcccagattttgtacaagttattatagacccaaagaaaagataaaaatacatcaaagaccaacagccgcatccgaggaacctaattcaatcttaatgtctaataatatgtgattaaccaattccgaatccaaatttccaaggccttctcttacccaaattgtttcaaatttccaacgagcctcgaggagccacaggaaacgcttacactctggataacaattattgtaacagaatggtgcagtgtggaatagtgaaccctcaggcatccaagttcaaagggagctcgagggtcccaaagcatggcttaccaaagggggcagaacttagaaactaggaataagtgcaaagtgagagagggattaaggaaccatagcagagggtggtcatacccagccatgggataggctggcacacccctaaccctttgcttaggtcaacaaataggagcagactctggggagtcaaacttagggtctgagtggtgattaggacactaccagacccaagttaaagctcaacacataaaggggagaggaaatgggaaagcatttgagtagagactcaggagagtctgattctggatcatggtcagcaatatcagatgttgccatgattcagaatagtactagcacacaaaagggaatatagggaagggatttccatgcagaagcatgcactgccattaaaaaaatataagaaaacatagcagactgcagatgcaaggacatagaagaacatgctagagaacataactatagtgaagcatgtgtagaagaagagaactgaatagacatagtaggagagtgttatttaacttagaagtacataccagttttcagttctagtacagcagagaaacaacagcaagtagacagccagacagttagtaggaacaattcaaaacttcagcaagtacttggaagttcagaggaactctagaaatgttcagacagtaggagaaaagggaacaaagtgctcagtagagagacagtagtagagaaagtggtaatagagagagtagtagtaaagagagtcgtagccagtaaagatagagatgattgtgtgttgcaatggtgcagaaaagagttctgagaactgtgttgtgttcgaatgtttgtgtaagaaaaactgtgtcctagaacttgtgagagctgtgagcttttatagtgcaaaaacgagtagacaagaaggcaaagaaataaaatctcggtcaatcaaataaaatctcccttagtcaaagggatttgatttcaaacgagagtggtaattaagggaagaaaaacctttcaaagtagcataataaagggtaggttcatacagagtctatttaaggtaagaaactttagtacacgattttgagagaataaggaaacaaagtaatcaaacagccggaaagttttaaaagccttgaatgaacttagtcaggaaaatagggaaaaggctaagttgtaaaaatatcaatagcaaatcaatcgagactcagtaaaaggatattgaaatcaatcacgagctaatagtatcaattcaaaaagaacaaaaccctcgtatataagcatgctagtatcaagctagaaagaaagattggcataaacagttttagaatcataagcaaaaaggaaagcaagtttcagttcagtctatgaactcagcacaaatttgagagcctagggtttctagagtagaaccctagaaccaaaagctcgcaaaatccccaaatagggtttcagtccgagtaggacacacaaaaagagaaggcaaactcaacaagcctggggaactctttcagaattccctgaggaaatacacagacatacgtagcaatcgaaagcagtagagtgcaaactaaaactcaaccagttcagaagagagaaaagatgccatagaactttaggaagtagtaaaagaagaaagttcaataacccaaataaatccagtaagagtaacacttttagtaacagaaatagtaaagggacaggcaagataggcgtataaacatgcttatagaaaaatcagtagaagcaataataaaacaaaggcagagagacatgcatattaatagcaaaacataagaaataaacgaaaaccccctaaagcatggcatgaacacacagattcagataaagaaagaagaagaagaagaagaatcgttttaggattttttttgaaaaccttaatttaaatagactaattttaaaaagggaaaattaggggaaatcgttaaaacatcgaatagagcatagatctgctacagatctaagaaaataaggaaagaaaaacctcgaatcaagctttttagagacgagaaggcctggaatggtttggtctcttaacgaatctgggccatggctaagccttcagagcttgaacacgccggaacggagccggaggagccacaagaactcaggtcggcagaggacctgaacaggtctgtggaagattgatccttaaaagcctcgaataatcatggcttggggtgaaaggggagagaatataggttgtccatggcctgggaagccatggacgccggtgggtttggtcggagactatgatagacgggtagggtttcgagtggcctagagagcatttgagagaagaagggatttgggggaggtggtcttagagaaaaaaatttagggttagggggtcggatgaaattaaaaaggaaaggaagaaggggtggccgttgattaatacaatcaacggccaagagtaaaagcaagagacaggcgggttaggttaattgggtttggatcgggtaaaaatcaaaattgggtcgtcgatttgggcctgatttgaggtcaattggggggtcaagataggctataattgaaagaaattgaggccatgattgcaatagccagttttcccttttgatttttttaaaaaatagcaaaagatgtttgaaaaccaaattgaaggcactgagtcaactaataatatataaatattaattcaaaaatattgggatcaattttgtaattataaaatgctattaaatcttaaagaggctagtattgcaattatatgcaatttagttttaaaaataccaaacaaatttgtaaaaatatgcaaaagtcatgccgattatattttgatataaatatgaaaatgaaataaattattctccaaaatggcaagctttgggaataattatgggattttatggtgtaaaaataggccataaattggtttaaaatagttaaaaaatgccaaaaccctttggggtgcttatatatgcacatatatgtcattttgaaaatatgtagggaaaattgggtatcaacacttggtagtagaataagggtaattatgatagataagaggatgacgcttgggcctttgattgggtaatgattcaaagtaaaaagatttcataaattgcacgggattataatacccccataagatgaaccattttaggatgctatgaaatacatgtatttaagtataatatcgtcactatgtggatcatgcaaatcaattcaaatgttccccaatgagatgtgagcgttagtgacaatgtattatgtgagaggtttaaagttatccttggtagattatgagttattttagttttatgatagtcgtgtattttgttttaaagtcaagcgagttgtggaacaaaagttggaaaaaatcatcacaagttacattcatgaatatgctgaaacttaggtcaaatgtagctgagaatttgtcccaatgtatagggaattacggtatgatctacctaccaaattaaagatctacgagtctagtttctaactgatcaaatcatttattgatacaacattttagtagagacatattcaccttttttgtgagactgcacagactggtaggtgataagtagttgcatcacctacttgccaaaaggagcagcctcaattaaaagctcctaaactcggccaataggggacttttaagggatttttaactcatttctttcactcatcattcagacaaagaaaaccagtttgaacccctgcaactcctccccgaaaatcccgcacaaaccgtatgttatttcgagtgttacgatgtaattctaatgccgaaaaccccggacaacgttctagtttctctttttccttcttgtagctatgttgggggattgattttggatgaagaagggctagttttcgtgggttctacttagtccaaggaaattttatgcttctccttccattatctatgcttgtatgagttgtaactcaatcataaagactaaacctagcaagtttcaaaagagtagtatgctgtttgttgttgcatcaccgttggctggttgtaaacatatttatatgttggattcaaggctagtttacatgataagaggcttaattatgtattgtttgttgtgtttctcaaattgaaagaaaagacaagttgaaacatattttagtaaactgaaaaatcagttttgagttgctgagcttgtgggactgttttgtgggcagttttgtgttgatgttgggttttttcttttcctactatttttatggagtttggtaggagaaaagggtttggataaacaccatataatggtagggtggttggctggtcgttcgttgttacatttttgggttgtttgacactactagggttgtcgttttgtgtatgaactgattattgtatgtaggttgttttgtggtatttatgatggatataatgttggaaaatgatgtatacatgttattgttgtattctttttgttgttagtgttatgtcaaattgggaggaagtaaagattataggggagttgctgcccgttttattataaaataagtttgtcgttcgttgtgcgatagttataccttctgtaaattaatgatagtgttgttatcgttgttgtagattaaaacggaacgagacgactttaacgtggtttttggacagatttgataagatatgttaaagaaaaacctttccttcattttggcatgatcccataactatatgtgtttgataactagccataaagagaactttgtattcctaaagatatatacattatcctagtttcataagttatagtattctcccatatcgggactttatatttagtttaatattgtcttctttcagccaaaagagcatagagtctgtatatatatagtattacagtattttcaccaccaccgagctataatcggtgggcaggtccttattgggcaacctctaatcagatggtaatttatatactgaggctactatggctgagcgcctatgagcgagcccaaaatggccgagatacagagcctagtatggtcgagtgcctatgagcaagcgtactacgaaagagtaattatatgtatcgagccttatagagtgggaaaactattttacttaatatatttagagatttgagtcagtatcagatggtaagcatatcttcagatcatctttgactcctagttactttcagttataatattatcagttcaatttcagctttcacttattctattgccttacataattggtacaatatttcgtactaatgtcccttttactggggacgctatatttcatgcctgcaggtcctgatagagagctggataaaccttcttagtagacagagccaaacatcaacttggttggtaagctccacttcctcggagttaccaggtctagaccttgaagtccactttatatatacaggtttgatggtaggtcgaggccctgtcccgaccatgatatagttttgttatctctagaggcttgtagacaagtcctgtatagtttttatatcagtagatgttcatgacagcctcgtcagcctacatagttatatatatatgtatatacatatatatatatatataccatactgggtgacgaccacgcctccccaagtttggggtgtgagatgaatgtccaaatccaatggcatttcctctgccgaaatgaatgccaaactacccatactctcgacctttctgctcaaggcatccgcaaccacattgtccctgtccggatggtaaagaatggtaatatcatagtcctccagtaactcaagccatctacgctgcctcaacctaaggtccctctatttaaacaaatgcttcaagctgcgatgattggtgaaaaccttacaggacaccccatagagataatgccttcagattttgagagcatgaactatcgcgaccaaatccaaatcatgtatggggtaattcttctcgtggcacttcagctgatgtaaaacatatgcaataactcgcccttcctgcatcaatacacaaccaagccaacgcacgaagcattacaatacacgacatacatcccagaactatatggcaacactaacactagtgttgtagttaaagcagtcttaagcttctgaaaactcctcatcttggtcgcatggtaaaacgaggctaactctagactgcctcgatcttccttggatctaccttaatcctatcacctaatacaacatgccccaagatagccacaaaattcaaccagaactcgcacttgaagatcttagcataaaggttctgttccctcaaggtctgaagcactaacttcaaatgccgctcgtgctccttcatactatgcgaatagatcaatatgtcatcaatgatgacaatgacaaatgactaaatatacggcctaaacggtcggttcatcaaattccataaatgcaaccggagcattggtcaagccgaaagatatcaaaaaaactcatagtggctatatctagcctggaaggccgtttttggtacattccaagcatggatcttcagctgatgatacccataacttaagttgatcttgggtaacaccctagcactctgcaacatgtcaaacaaataaccgatgcccgacaatgagtgcttattcttgatggtggctttgttcaactagcggtaattaatgcacatccccacactcccatccttcttcttcacaaacaataccagtgcgccccaaagtgacacactgggtccaatgaaccccttctgaagcaactcttcaagttgctcctttaactctataagctccttaggatccatacgataaggcaaagcggaaataggcttcgtgcctggcaccaaatcaatatcgaaattgagatcctgatccggcggcgtacctaatagatcaacatgaaatacatcagaaaactctcgtactaccggcactgaatctaatgtgaaagtatttgcagtagtatcccgaacaaaggccaaataggccaaacaacctttctcagccatatgttgagccttcaagaaagaaataacccgattggaattaccaacagacgaacccctacactctaatctgacaagtcaagcatcgccaaggtaacaatcttggtataacgatcaagaatgacatggtacagggacaactagtccatgcccaagataaccttgaaatcaaccatatggagtaataaaagatccgttctagtctcaaatccatataaagtcaccacacaagaccagtagacctgatccacaatgacataaacacccattagtatggacacatatacaggaacgcctaaggactctcgaggtacatccaaataaggacaaaatagagaagaaacatagtagtaagtagaccttggataaaataataccgaggcatcccaacgacagacataaatagtacacgtgatcactgcatcggaggcgactcctcgagcctggcaaggaaaggaagaatctagccggagtgccatctaactagcctccacctttatggcgacccctacccacctaccctgcacctctaactggcctggtgggcggtgtggtagatggtaaggtaatcataggccaatggtcctgctacttgtccttgccccaaagtctgggacaaaaccatttcacgtggccaagatcctcacactcaaaacaacccctcggagtagtggattgctgacatgaagtctaaccttgatggcacgaatcccactagaggaacccagaatagttggcggatggtaagtactttctggaatggcactgacgtagggtcgtactggagcactctgagcaagcggtggtgctgacaacatgggtctgctagactgacccctcacaaactaacctctacccctaggtgggctgccactgaatcctccaaactaccatggcttgttgtccctcggtggaaactctctgttgtggttgcgaatatactcaatcttcctagctatatacacaactttatgaaagggagtccctatcactgcctaacgggccatgaaaacctgaagctcagggtgcagtcctgcaatgaacctctgcaccttctcttcatctgtggggagtacaatagctacatggcgatacaagtaagtgaatctcgcctcatagtcggtcatagacatatgaccttgacagagtccctcaaactgacctcgaagctcctctctctcaaaaggtggtatgtacttctccaagaacagatgttgtaaactgatcccaagtcaagggaggtgaacctgcctcctaaggaggtaagcttgccaccatctgcgggccttgcctcaagtagaaaggtggtgaagtccactccgttggactccaatatccccttgttccgtagtatatccttgcatcggtcaatgaaatcttgggggtccttcgaccgctcacccccaaagttagaggggagaagtctagtccatctatccagctgcttctgttgatcaacagtcgcgactggtacagactctagaaccgtaggtgcaactggctggggcccgcccgtaggtagtgcacctggggtccgataaacggcagcgacttgccttagagcatgagtggcaggggcttgtgctccccctcccgcctgagatatggctacgtctgctagaaataaaccatcctgcatcatatagtctatgaaccacaacatacaacccatgaccttttggaatcccgatgcagtcatgaaatctgttggggctggctaagctgtaggcgtcttatccttctcctaaataataggatccttcactggatccactggtagtacaacaggagcaactctaggacaccctcgtgctctgacaagagtcggagcccttcttgagcctcattctgtagcaacagggggagcaactcctctattgcctggtgcatccgccacgaatattctcaccatctgtgagagatcaatagaaagatacttagcaccaaatctactacacgataggaaatgaagaaagataagtttcctatcaccctatagtctctgaaagataactacaaacatctcggcaccgatccgcacgactctactaggcctactcatgactcgtgagacctatgtgaacctaaagctctgataccaagatgtcacgaaccaaaacccatgataggtcgcgatggcacctaacactactgtttggcaagcccacaagtgggcctataatttaattactcctttttaatagctaaaacacaagttttccttcttaaaagaaggaaataagtaagatttcatgcaaccgtacactcttttctcaacaaaataccagcgtgataaaatacatccattgtagtgacagtaatgataagcaccacaatacataaatactaaaaagtccccaaaactcggtgccataagtgtatgagcaatctagagagtatataaaactaatacaactactgtttgaaaggtaatagataaaaataataaacaaggtagagggagactccggtgctgcagatcgtatcaaggaaagcaaatcaccactaagtctccgtagaagtgcggctaagagctcatgtgaccgctggtagtacctatatcagtacctgcacatttagtgcataagtgtagcgtgagtacgaaaaataatgcgtacccagtaagtatcttgtctaacctcggcgaagtagtgacgaggggtcaacttgacttttactagaggtcaaaatagtaatagaaatacataaagtagacatggtgagtgtacaacaagtagcaatgaagcaaataaaagtaactatagtaattccacacataagtctatatcaaatcactaaacatgtaataaccggccttgaaggtgcaaactaaactgttaccaaaccaaatccagtctcaattattaagcacgaagctaccaaggcgaatgacccgatcccataagaatagtgttatcaacctgcaggcgaacaacgcgatcccataagagtagtgttaccatactgccaaggcgagcgtcccgatccgacaagagtaaaaaagtttacctcactcacgaaaacacatgcgaggagagatgacacggatctatagtttatcaaatatttactatttttttcaaagtaagaggctaagtcagtatctttattaaaatccttaatctcagtcataatcaagaaaattaatagacatgataggcataaataacataataaaaggcatgttgtgaatctaagtttacctggacatatcatgaatataactacatacggactctcgtcaccttgtgtgtacgtagctccccacaacaagtagcacacaactattaatacaccaagtcctcaatccgctctttaaccttactagaactcctcaaacgatgtcgaggagtccgaaactaaccaagagtcgtataaactaataaatatatgttcaaaagttcataatttaactattaaactcatttcccaaccaaatctgggaagtccataaaaatcacctcatacctacgtgcccggattctgaaatatttttgaataaaaatgttacccatgacctcagaaactcaaatatataatttattcccaattacataatcaatttcgtggtcaacctttgcgatcgtagacccctcttcgcgtttccgtaggcaatcagctgtccctctaattttcctttttcatgatcgcaggaccatcttcgtgatcgtgaagcacaccagcacaccaacacactagcagtctttagccaagttcaaacatgctccgggtggtccaaaacacacccgagtcacccgggaccccatccaatgcaccattaagtccataaacacattgtggtcctactcgaaacctcgaaacacataaaacaataccggaatcaagaatcacacctcaaaacctcattaatcaacttctaagcttcaaacttattttaaccaactctgaacgcgtcgaaacatacatagacaactcaaaatgacactaaattttacgtacaagtcataaattaccatatggacctattcctaggctctgactcccaaacaaagctcgataacaccaaagtcactgcaaaacaaatttaaagaactagaaaacctttaatgaaccaacttcaacattaggcgcagaaacgtgcctaggttacccaaaactcgaaccaaagacacgcccaagtttgaaatcatcatacgaacctattagaacaatcaaatatcggttccaaggtcgtttactaaaaatgttgacccaagtcaaacttaatcaccttaggctactgttaaggaactacgtgttccaattttaacccgaaccattccaaaccagccatccccccaagtcataaaatagtaaaagcacctgcaaaaagtgttaattaggggaaaaaggatctaaaaagcaaaacgattggttgggtcattacactaactcaggtgtcctttcagtttactctctttgtccaattttaactatcattttatcttgttactagttactagctcgaatgataccaaaggtggccacagatctgaatcgagggcggacgaatgatatattgggaatcaagcatggcctaacccgagaagaatcaagctcaagagaaatgaagaattgagggtaaaggaaagatggttaaaatagacaaacatggagccgaaatatctgcaatcagctggatattgcaacaccaatcacgttcgatattaactgcggattatgttttcttgggagaaaaggaaggggaggatttttaccttatttagacttgtattagggttaaaactcctctactatataaagaggggaacctttctattttttaggtcactattggcacacatatcaaaataataaagtttattctggcttttagcaaattgtctaagtgttcttcaatcgctcattgacttagccgtttgaactccatctcgagggctcagttatggtgaatagttagtgtttaagactaacatggggcctaattacttcaacatattggtttgatagtttattctcacttcaatttaattatttattgttctttaatcatttgtgttaaattaaaccacatatcctttaaatcgcatacaaattttattgttatccattttaagggtaaacaatttggcgcacatcgtggggctaacgataatagtggtgatttaaggtgaatcttgataacatacactattttacacttgttgatttcaggactgttctatatgttagatttcaatctggtcacataagtgttgacgccgaatcaggccaccatggtgaaaataacaacggcttgccgagttacaatgtagaccctgtcgaccctcatggcattccattcgcttaccaaattgatgctaattcacaggatagtgtcaatgctaacctaccaactaaccccaataacaacatgcatggggtaccttgaccgtcggtttgcgaggcacccgaagggggaggtgatgaagttatcttgcgtttgatttttgagattttgtaagcctaataagttgccatagtacaaccgttgattccagatcacaatgcggctgaacctgattggtttagagaagatgctcagaaggaagaatggattgtcatagaaccctacgggcccagatccgtggaaacatccgaggtgataaaattcttgaagcactgacaaaacgagtagaatctgacgaaaagaagatataggtaaatgaaaataaagtggaaacttacaagatcagatgccgggagcaccttcgatatttaaggggccagattctaaaaagttcattaagaagccttttcccctgagcgcgacaccaaaaccaattctgaaaagggtttggatgcctgatattttcaaatacaacgggaccatagatccaaacgagcagatgaccttttacacatgtgcaataaaaggaaacgacctcgaagatgattaggtcgagtcggtactcctaaaaaaatatggggaaaccttttccgagggagtaatgatatggtatcacaacttacctccaaactctattggttcgttttctatgcttgcatatgcctttgttaaagctcatgttagggctgttaaagttgagatgaggaaatcatatttgttcaaagtcaagcaaagggctaactagatgcttagagaattcatgtcgagattctaaatgtaacgaaaggatctgcccccagttgcagacgactgggccgttcaagcatttactcaatggctcaacccccaaagcttgattgcatctcaacaattgaagcaaaatttggtagggtacccagaggttacctgggttgatgtctataacaagtatcgatccaagataagagtcgacgatgaccaactaggggctccctcggggttggtttatcccaatagatcaaatgaccagtctaaaagaatagtggatcagaagttgaggtcaccccgagatcgataccaaccttaaaactcaaatagaggggaaaacagacctagtctctacccgactaggaacaatagaagaaatgatcatagtccaagcaatcgagggttagtgaatagaaacggtttcggcagatcacacggagtcaaagattccccaaagctatcagaatataactttaacgtggatgcaacgagtaacgtgttagccatcggtcacatcaaggataccaaagggtcgaggccgcttcagcatgatgcggaacagtgagatcacaatttgatatgcaaatatcacggtactcatgggcatagaaccaaggattgtcggaagttaagggaagaagtggctcgtttgttcaaaaattggcaccttcgggaattcccaagggagtgggccaaaaaccatttcaagaatagggacgccaacaagcagatcgagtaggaagaacctcaacatgtgattaacatgattattagaggagtatacattccatagggatagatgataaaacgcacccaagtttctatcacaaaagaaaagtgaactagagattatgttccagaaggatctatctcgattagtgatgaagacgctaagggaatcattcaaccctacaatgatgcactggtaatatatgtattcattaataaatctcgagttatgtgtgtgttaactgatccagatagctaggccaacaccatttgatggagagtcatagaacaactagggttgttggaccagatcattccaggagtttaagtactgaacgggtgcaatatggcgtgcgagacaacaaatggtgaaatcaccctactggtcaacacagtcaagaccatttagcaagagaagttctatatgattgaaggtgatatgaggtacaacaccttattcggaagaccgcaggtttatagtatgagggtggtaccatcgaccttgcaccaagcgttgaaatttctatctccatatgggataaaaatcatctacggggaacaaccgaccacaaagaagatgtttgctatcaaagaagtgatccaaacacccgtggtcacaacatcaaaagataaggaattatcgaatagaaaggaaccaaatgacaatcacaggtctcggcctcaactgaaccagaaaaacaggaggagtatctaaccgatgaagaagatgatttcggggtcccaagattcattatattaccaataaacatcgattccaccaagtcaacaatcaaggaactggaataagtcatattgttcgagcatctgcctgatagaaaggtatacctgggcacggggataacccccatgctcaggaaaaaactcattgattttcatataattaatgtcgattgctttatctagtcttacttagatatgacataaatcccactggagatagaaactcacaaattgagtttggatccgaacttccactcgattaaaaagaagaggaggccacaatctgaagtcaagcttgcattcatcaaagatgaggtatctaaacttttaaaaataggttccattcgggaagttaggtacctagattggctagctaacgtagtcgtcgtacctaaaaagggaaacaaacttagaatgtgtgtggattataaggatttgattaaggcatgtccaaaggactcatttcctttgcctaacatcaaccgaataatcgatgcaatgacagggcatgagatgccgagctttcttgacgcctattcgggtgaccccaaattcggatggacctggggaaccaagagtaaacttattttataactaaattcggaacttattattataatgtgattccatttaggttaaaaaatgccggttccatgtatcaatgcctagttaatcgaatgttcgaggaataaataaggaaatcaatagaagtttatattgacgatatattagttaagtccctgcaagtagaggacaatttgaaacatttgcagaaaacctttgacatatagagggaatatgatatgaaattgaattaggagaagtgtgccttcggagtcggctcgggcaagttcctgggcttcatggtatctaaccaagaaatatagatcaacctggatatgataaaggccatagaagatataaaagccactgatttttctcgttactaaagaaaatgagtgacttttcttagagcccatagttccataaggctttggaagaactcaaacaatacttatcgagccctctttttctgcacaccctgaaggcaaatgagcatctatacctttacttggcggtgtttgaggtagcggtaagtggtgtcccagttcgaaaagaagaaggtacacaatttcctatatattatgatagtagaactttatctaatgccgatgcatggtatccacacctagaaaaattggtgcttgccttgctaagcatatctaggaaacttaaaccatattttcaatgtcatcctatacgtttcgtgacctcgtacccattaaggaatgttatgcataaacccaactcgtaggtcagctgacaaaatgggccgtagagattagtaggtacgatattgaatacaagccctaaagaactataaagtctcaaatattggcagacttcatggccgatttcacatcgtccatgattctccaagtcgacaaagaattattactttccttgggaactagctcgggggtctagaccctattcacggatagtgcctccaacatgaaagggtcctgatggtaggctagaaacccgtatttgaaccagagtttacactttaactaatgcattttacgtttgtttgagcataactgataatgaattgtacttattatgtgtttttatgtcttgtaagagttaattccaagtttaaaaggtgaattggagctaaatcaaataagttggagctttgaagtattagtaaaaccccaagaaatccagcgaggatcacgctcaggggtcgaggaccaagtccgaatgtcaaacaatgaaagaaacaatttactctagaaaaactacactaccacgtcatatggggtgccacgaggcgtgacgcaatagtgaaattcctgcctgacaaacaaaagtcaagccccctgataaccgccacaggcaagccacgtggggcacaccctacgccgcgtctatgcattctgggttagagtaatttctgtttcagcttgaaaagggtagtttcatccgggcccagctttacactgtttaaatacatcaaaaatatgtttttgaagggacttttgacctacaaaagatttgagaagtaaccaaggcaagaaaatacaagaattcatcaagatttcaaccaacaatcggtgcaatacgggagtttgtatcgaatcattagcattgatgttttctttgcttttaaaccttattgagatgactttttccattgctatggagtaatttccatttgggtattgacagatatggtgttttgattagggatttgattcttgataattgttggaattaattgatggagtcttaattcgtattgtggagttacttcttattttgcttaatcgaacgaggagcttgatatttaatttcattacatcttatgatctagttttaattcgtgattcaagaaggtaatcgaaatagcctcttgaattattaatcaaactagaaaataggaaaatatttgtgagaacttacctttagatcataaccatcattttatatttgcaattgtttactgttgatacccaattttttcccatatattatttaatatgtatatatactttcaaatagcacttatgcagttatgagcatgcataaacattttttataatttttaaaatctccaaatcaatttatttcctctcttttatttttaaaatatccaataattattctccaaattacttttgtgatgatttagttatctaaattctttattgataccaacatagtgattaaatatttttagtacattttttgtaattatattatcattttaggctaaattgcacatctttgcaataatagcccatactaatgcataattacattattgatgcataaaatggtcttttatatttttaaaatattaaataactattttaaatcattttagtacacgaaaatatttttttagtacaccaaacccgaatcgtcccgaaaaccccacaaatagccctgacctaaaataaactaaatgacccccccccaaaccctctcatttccttaccgtctgccgctttgaaatccctctcctctctcaaaatgctctcaaacctaaccctagtcgtcactcatatatggctatcttggtggcttcccaccactccccatgcctctaatggccccccttacgttggtattgccatctccagggtcctcaagggaccaaggttagttggattgcatctatggcccctttctcacttgtttcagactatgatctatgggtttctaagcttgtttcttcacctctgtcttgttctactcgaaaccctaatttctttcttctgaacctcttagatctatacagatctgagatgatttagacttgtttcatatgatttttacaataaccttgtaattttttacaagaattgtatgattttcgagtgatttttcatctttctataagactagggtttccggaaatttcttttttcaaacatttggtaatttttgagtgtttgatcttcttcttcttttgtgttttaactgatttcgtaagtttgctataaccttaacttgtttatactaaaacccctaagttttgacatttctttgtttggtttctgattactagtctactgattgtgttctagccttagttcttgtgatttctctttagtcatttaaatgtctcgtggttttgttgtcctaatatgcctctactgaatttcttagttcaacctttcactgatttatatgttcgtgttcctcctgtttcttcatgttatgacctatatctttctccttgaattagtgccgatttaactatttgttttttaaaattatgtgtcgaatccggactattcatttcttaccttattctatctacttaatttgctgactctttatgtgaatttctctttgattgaacccttgattattctgaaatccttacttcctggtttgatttgaacatttttccttaacaaaacttttgattcttacctgtcacgaccccagttcgcccttcgtgaactgtcgtgatgacacctagtctctacaactaggtaagcctaacaaatgaggaacataagcgaaacttgcggaagaaataataaaaaaccaaaataactgaatggaaacaatagttataatgccgctcgacatatacaacaccacattttcaaaaccaagtacactatcccaaaacccggaaactcacgaaaactcaagccttttgaatatctaacagtctatctccagaatatctaacaagaaagaaaaacaatacagaagggcaatgtttaacaactagaatagaaagggacttctcggtctgcggacgcggtagatgtacctcgaagtctctagagtagtcgcctcctcaaggatgataggcctgagtagcggtacttggatctgcacatgaaaaacatgtgtataagggtcatgggtacaccacaacggtactcagtaagtgccaagcctaacctcagttgggtagtgacaaggaaggtcagggcctactgagattaaataaatataaagatgacaggataagataagcagtacaattgagaatctacagtaagaatctacacaggataataagagtacaataacggaaacagagatgaaggcaaaccacaaggaagtacaactcataacaaggatgataaccgggaatctcttggtatcttctatgcatacaagggatctcttggtatcccggggatctcttggtatcctcaatatatgttggggatctcttggtatctcgaggatctcttggtatcctcaatatatgttgggcatctcttggtatcccgaggatctcttggtatcctcaatatacatgccacggatctcttggtatcccgtacttcagtctagattataaatacgtacaagggatctcccgggatgccatcccatagtcccaaattaaaaacacacagcagcaacgtaagaatactcaataattgctaaatttcgaactaagtaaacaattaattctagtctaacatgcttcacgaaatacaattgaggtagtttaagcaaataggcaattaagtcaactaagcatgcttttctaactaacaacaggccaaaatcgcaagtagaataaaacaggaaaaaggaacttaattgaaatacttaaagaaaaaccagattttcaacaattagctcaagtacgcactcgttacctcacgtacaaagcatttcaattattaaatatgtcatatcctaaggggaaggtcccctccacaaggttaaataagccacttacctcgaatcggctcaaaatcaatccgaaaccacgctcttgccacgagtactcgactccaaatggctcaaatctattcaattcaatttcataacttaaataacacttcaagtaactgaatctacaattaaattctaagctaatacgcgaaattaggtaaaatgcccaaaacgtccctcgatcccacatcttggaatcaggtaaaatttatattatcagaaacctcacactctcacgagttccgtcatatcaagagtaccaaaattggacctcaatttgtcccacaaatcatcactcaaaggtctccaattatacaaaaatctttaattttccttaatttttcatgcttaaattgataaaaatcactccaataacgagtttacggaccaaagaccttaccccaatgaactcctctgaaagtccctcttgaaaagtgctccctaagcttctttcctaagcttatgcccagcaatttctgcatttacggccctcggaccgcatttgcagagccaaggtcacatttgcgacttttcattaaaggccaagttccgcatctgcgactcccaatcagcagatgcggtaccgcttttgcggaattaccaccgcttctgtaattcctgaagagattcccaaatttcgcgcgctgcacctgcggaacccaaaccgcaggtgtggttagacagaactagcagctgaagctgcaactctaactccaaaatctttctgtcaaccatctgaattcatcccgaggcctcagagacctcaaccaaaggcacgaaaaagtcacaaaccgctatccaaacttgtaccaatccttagaacacctaaaacaacatcaaaacctcgaattaaccatggattcaagcctatgaactccaaaattctcaaaatacgctttcgatcaaaaggtctatcagacctcgtccgaatgacctaaaattttgcacacacgtcacattcaacactacagagctactccaactttcggaattccattcctacccttggatccaaatctcactatcggaccaaaaatttcaaatattcaactttcggcatttcaaacctaaattagctacggacctccaaaacacaattcaaacacgctcctaaccccaaaagcacccaacggagctaatagaaccatcagattttcattccgaggacgtcttcatactgttctgactacggccaactttccaacatttaagctctcatttagggactaagtgtcccaaaaatctccgaaactcaaaaccgagcatcccggcaaatcaaaataatagaaataaactcgggaaaagtagttaataggggatcgaggagttaattctcaagataaccggccgggttgtcacatcctcctacacttaaatattctttaatcctcgaacgagcatagagacatacctgaagtagtgaaaagatgagggtaacagttgcgcatatcttgctcggtctcccaggtcgcctcctcgaccggttggccccgccactgaacttttactgatgcaatgttctttgacctcagtttttaacctgcctatcaaatattgtcactggttcctcaacataagatagatccttgtccaactatactgaactgaaatccaacacgtgttacggatcaccgtgataccttcggagcatcgaaacatagaataccggatgaactctggccaagctgggaggtaaggcaagttcataagcaacctccccaacacacctcaatatctcaaaagggccaataaatcttggaatcaacttttctttcttcccgaatctcataacgcccttcataggcaaaacccaaagcagaccccactctccaaccatataggatcctgaaccatgtctatgcccaataatctggcctcacctggctcaaaccaacccaccagggatctacaccgtctcccatataaagccttatacggtgccatctgaatgctggactaatagctgttgttgtaggtaaactctgccattggaaagaactaatcccaagaccctccaaactcaatcacacacgcacgaagcatatcctcaagaatctgaatagtgcgcttggactgtccgtccatctgagggtgaaatgttgtgctcaactacacccgagtacccaacttatgctgaacgaccctccataaccgtgatgtgaattgagtacctctatctgaaatgatggacactggaataccatgcagacgaacaatctcccggatataaatctccaccaaccgctcagaggaataagtaatacacacaggaataaagtgagtggacttggtcaaccgatccacaattacccaaatagcatcgaactttctcaaagtccatgggagcccaactacaaagtccatggtgattcgctcccacttccactccgggatctctatctgctgaagtaacccacccggtctctagtgctcatacttcacctgctgacaattgaggcaccgagctagaaatccaactatatccttcttcatccgcttccaccagtagtgcttcctcaaatcctgatacatcttcgcggcacccggatgaatggaatactgcgagctatgggcctcctctagaatcaactctagaagcccacaaacactgggtacacaaatccgaccgtgcatcctcaattccccatcatcactaatagtcatatctttggcatcactgtgttgaaccttctccttgaggacaagcaaatgagggtcattatattgccgctccctaatacgatcaaataaggaagaccgagaaaccatgcaagctagaaccccactgggctctgaaagatccaatctcataaactggcaggctaaggcctgaatatccatcgccataggcctcttcgatgctggtaaataagccaaactccccaaactctccgcccggcgactcaaagcatcggccaccacattggccttgctcgggtgatacaaaatagtgatgtcatagtccttcaacaactctaaccacctcctctagcacaaatttagatccttttgcttgaacaggtgctgcaagctccgatggttagtataaatctcacaaggcataccgtataagtaatggagccaaaacttcagggcgtgaacaatggcagctaactcaaggtcataaacattgtagttcttctcatgtattttcaactctctagacgcgtaggcaatcaccctaccatcctccatcaacaccgctacgataccaaccctcgaggcattacaatagactgtataagatcccaaacatataggcagtatcaaaattggggctgtggtcaaagctgttttgtgctcctaaaagcttacgtcacactcttccgtccactggaatagagcacccttctgggtcaacctggtcataggggccacaatcgatgaaaacccctccacacaatgacggtaatagcccgccaaaccaaggaaattgcggatctcggtagctgaggatggtttgggccaactctgcacggcctctatcttctttggatctacctgaataccctcactcgataccacatggcccaagaataccactaaatccaaccaaaactcacattttgagaacttagcatataacttcttctctcttagagtctgaagcatagtcctcaggtgctgctcatgatcttcccgactccgggaatacaccaaaatatcatcaataaagacaatgacgaatgagtcgagatacgaccagaatacactatgcattaagtgcataaaggttgctggggcattgttcagcccaaatgacatgacaaggaactcgtaatgaccataccgagtcctgaaagtagtcttcgggatatttggctcctaaatcttcaactgatggtaacctgagcgtaaatcaatcttagaaaacactcgtgcgccttgaagctagtcaaaaggatcatcaatacgaggcaaaggataacggttcttaactgtcactttattcaactggcgataatcaatacacatacgcatagagctatcctttttattcataaacaagacaggagcaccccaaggtgatacactaggccgaataaaacccttataaagcaattcatgtaattgatccttcaactccttcaactgaagaagattcatatgatacggaggaatagaaatgggctgagtgcccggcaacaaatcaatcccaaaatcaatatctctatcaggcggcatacctggaaggtcagttggaaacacatcaggaaaatctcatactactaggactgaatcaactgaaggggtatcaatactgacatctctcacataatctaaatacgtgtcacaccccttctcaaccatacattaagttttaacaaaagaaatcactctactgggagtgtgatcttaagtacccctccactcaatatgcggtacacctagcatagcagcgtcacggttttggcgtgataatcaagaataacataatggggcgacaaccagtccatgcccaagatactgtcaaagtcaaccatgctgagtaacagtaaatcagctctagtcttaaaatgacaaagagcaaccaaacacaaccgatagatgcggcccacgacaaaagaatctcctacaggagtagaaacataaacaggggaaatcaaagaatcctgagatacacccaaatgtggaacgaaataagaagacatataagaataattagagcctatatcaaatagaatcgatgcatctctgtggcaaaccaatataatacctgtgatgacagaatcggaggcaacagcctcggtacgggcaggaatggaatagtatctaacctggcctccccctctagggcgacctctacctcccgacctccacctctagctggctgagcaggtggagtagcaactagagttgtaatcatagcctaagaactctctgtggcacgctatggctgagaagtttgtggaggtgcactcctcccaagtctagggcaatccctcaccacgtggcgtgtgtcaccatactcaaaataagctttgggaggatgtagaagctttgactggctcagaccaggtctgctggattgacctttggaaacaccccacacagaaggtgcgctagaaaccggaggtgcataataaggctcctgaatcataggaggagctggagcactactggctgttgggagagctgaatgaataggatgaatcatataacccctattatgacgaccttcagctggggtacgggcacaagaataatggcccgacactcgagaccccttggcctccctctcctctcactccctagcatgcataccctcaatcctcatagcaatgctcaccacctgctgataagaaacatccatatccaactcacaagacatgctagacctgatgctgggaataaggccctcaataaaccggcgaactctctcctgaacagtagaaaccaaggcaggtgcatgcctagccaaactagtgtaagagacagcatactctgagacagtcatagcaccctagtacaaatgctcaaactctgcgtgccatgtgtccctaaggctctgaggaacatactctctcaggaacagatcttaaaattgagtacaagtcagtgaagaagccttatccggactgtctaacacattggtgtgacaccactcaaaggcagctcctcgaagatggaaggtagtgaaggaaactcttctcgatcctaatatacccatggtacggagaacgcagtaactctcatatagaaatcccaaagcatcctccgatgctagaccgttgaatacatgaggcttgtacttcttgaacttctcaagcctcagctgctcctcctcgaaagtcgcttccctatccccgggctgaactggtactgcaggcggtacatgaataatcttagggacctattcaatatgcactctctgctcaggagtgcgggtggcgggagtctgtgcttctccccccgcctgagaggtggctgtagcaaggggaagcaaccctacctgagccagagtggtgtacatgctcatgaactgtgccaaagtctcatgaaaggctggagtagtggtagcagtagccgtgtcaggcacctattctccggctggaattgatggtggtacctcagcgcagctcgcgtaggtgttctggttgcaccatgtacgcgtcctttgcctctaccccggccctggcctctgacggttgcagtagggggtacgggtgcctgatcatctctggtagtttatgtcctcaccatctgtgagagaatagaagatagaagtttagaattgtgatgtcaaaatatcgcacgacaaggaaatcaaatgaagtggaattttcctaacagttacataggctctcgtagataaatacagacgtctctgtactgatcagcgagaatctaataaacgggcttgtgatccatgactcatacaaacctagagctctaataccaacttgtcacacctcagttcgccctccgtgaactgtcgtggcggtacctagtctctatgactaggtaagcctaacaaattcagaacataagcaaaacatgcggaagaaataatcaaaaaccaaaataattgaatggaaataatagatataatgccacttggaatatacaacacaacattctcaaaaccaagtacattatcccaaaactaggaaactcatggaaacacaagcctttggaatatctaacagtctaactccagaatatctaacaagaaagaaaaaaatatagaagggcaatgtttaacaacttgaatagaaagggacttctcgatctgcggatgcgacaaatgtacctcgaagtgtctagagcagtcgcctcctcaagtatgataggcctgagtagtggtacctagatctgcacatgaaaaacatgaacagaaggggcaagagtacacaacagtggtattcagtaagtgccaagcctaacctcagttgggtagtgatgaggaaggttatggccctactgagattaaataaatataaatatgacaggataagataagtagcacaattgagaatctacactaagaatctacacaggataataagagtacaataatggaaacagagataaaggcaaaccacaatgaagtaccactcatatcaaggatgataactgggatctcttggtatctcgaggatctcttggtatcctctatgcatacaagtgatctcttggtatcccgaggatctcttggtatcctcaatatatgttggggatctcttggtatcccgaggatctcttggtatcctcaatatatgttggggatctcttggtatcccgaggatatattggtatcctcaatatacgtgtcagggatctcttggtatcccgtacctcagtccagatcataaatacgtacaggggatctctagggatgtcgtcccgtagtcccaaattaaaaacacacaacaacaacgcaagaatactcaataattgctaaatttcgtactaagtaaacggtttattctagtctaacatgctccacgaaatacaattgaggtagtttaagcaaataggcaattaaattaactaaagatgcttttataactaacaaaaggctaaattctcaagtagaataaatcaagaaaaagaaactcaattgaaatacttaaagaaaaaccggattttcagatattagctcaagtacgcacctgtcacctcctgtacaaggcatttcaattattaaatatatcatatcctaagggtaaggtcctccacacaaggttagataagccacttacctcgaatcgactcaaaatcaatctgaaaccacgctcttgccacgagtactcgactccaaatgacccaaatctattcaattcaatttcataatttaaataacacttcaagtaactgaatctacaattaaattctaagctaatacgtgaaattaggtaaaatgaccaaaacatccctcgggcccacgtctcagaatcaggtaaactttatattatcagaaacctcacactctcacgagttctgtcatatcaaaagtaccaaaattggacctcaatttgtccctaaaatcatcactcaaaggtctccaattatacaagccctaactctccaattaacactaattttccttaagatttcatgcttaaattgataaaaatcactccaataacgagtttagggaccaaagaccttaccccaatgaactcctctgaaaatccctcttgaaaagtgctccccaagcttctttcctttttaaaagatgaaaaatggctaaatttctcaaaggcaagaatttatatgttatgcccagcgatttccgcatttgtggccctaggaccgcatccgcggccccgcttctgcgaagccaaggtcgcatctgtgacttttcattaaaggctaggttccgcatctgtgactcccaatccgtagatgtagtactgcttctgcggaattaccaccacttttgtggttcctgaagaaattcccaaattccgcatctgcgtccactaagccaacccaaaccgtaggtgcggttatgatagaaccacaggtgaagttgcaactctaactccaaaatcttttcgtcaaccatttgaattcatcccgaggcctccgggacctcaataaaagtcaccaacaagtcacaaaccactattaaaccttgtactaatccttagaacacctaaaacaacatcgaaacctcgaattaaccatggattcaagcctaagaactccaaaattctcaaaatacattttggatcaaaaagtctatcaaacctcatccgaatgacctaaaaattttcacacacttcacattcaacactgcggagctactccaatttccggaattccattccgactcagatccaaatctcactatttgactagaaatttcaaaaattcaactttcggcatttcaagcctaaattagctacggacctccaaaacacaatccaaacacgctcctaaccccgaaatcacccaacggagctaacggaaccatcggatttccattccgatgctgtcttcacactgttccgactacgaccaactttccaacacttaagctcttatttagggactaagtgtcccaaaactctctaaaactcaaaaccgaacatcttgacaaataaaaatagcagaaataaactcagggaaagcagttaataggggatcagggaattaattcttaagacgatcggtcgggtcgtcacattacctctctactctgtttaattgaactgcttgccttaattaatttttccttgccttatttatattttgctgattcttattgattgtttccttaattgaaacccctgtgcattcacccctaattacctactctgtactcgatttccttccttaagtatctgtcccgcttttaccattgattatcctttgattaaagggaaagacttactgattttacatgtgattgattccctgaatttctctaatttctacttaattgatcccttaccttattttgctaagcttttgattactatataaactcactcctattctcacttataacaacgaacattagttcacaaaaggcacacctacactctaaagctctcttttctcatctgctacttgtgatattcactggtctagccggctgaaagccaaggctagatattggaactacatctgttttatattctgcactctttacttcaactggtatgtctctagttaaattttgaaatccaaaccctatgtgtttcattcctgcaccctatgtgtttcattcctgcactagttcatcaaccatgaatccaacttgtattcctgcttacttctttacctagcatgtctaaactctatcatgttcaatgtatgattagcatatctacactttacctagttatttgatacttaaccagtctatttgtgaatatttgttcaatccctaattatgtgatcatgttggctatttgatgtatgtgatagaccctacttatatctttaatcctgttcaagacatatcaggctttttatattacaactgtgatctatatcttaactatttactgtccatgactagcctactaagtctctaagaccctaaatgttttatgcagtttgttgactatatgtttcctctataccctatccatatacccctattgtgactctaatgccccaatccctttatctccatgtgagatctatttgttgagtgtttctaaatctggatattttatggccaattgattgtctgttgtttttcaaaagagttttggtactcttctcaatctgtcttttaccaccaaactatttcttatttcagaaaaccttttcactcctaaaattatctctatactattttaaaaaccttatcaaaactatgtcaagcactctcactttactcttagaatacaaagttatgcccctctaatatgtgtgctgccttgatatccttgagatctctctgaactctcgcatatcagagctggcctttccacactgcacctaaatcagttattatttgagaaaaggtctaagtgtgagcactacccaggatccttgaggtccttagggaactctgacatacctagacatgaaattggctatagaactttggcatttaaggctattggaggcttggaagtcatttgggcctactgtaggatccctataaattaattttatatttatgtaaatttgtcatttaattcattggtctgtaataattattgtaaacaaactgtggggtgattagtgaaaaagggagggtagtcatatatattgggtaaattatgtagataccatgcctataggatccatgctaattcaaatgtgtttgttatatttactttacttccacacaattagaaaccattcctataggatctaaaatggctttattaatagagatcatgcctatatggttaaaaatcagctctatagaagtcatgcctataagggtttcactttggttaattgaatgatgtttgttttaccttgcttaactagaaatcatgcctataagacttaaaatagttcagttacaaagtcagttcaattcatggttatatattctgaagtggtttaattaacaaaatttgtctgtatcttaaaaaggttttcaaatgctgcctaaattaatactgctagaaaacatgtctataggatctcaagttgtccatttaaaaacaattcaatgttttactgtattcctaatcgatatagatagcatgctcttagtacatcactattatgcgcttaggcaagcctatagggtgattaaaatccaggaactacaaaactgcgctttgagactgcccacattcaacaggtctaaaatcagtaggattcagtctttgacactttggccttaattcagtactgtataatctttgctcacctagatatcatgttttagggttttctcttaaaatacttgaaacttttatttgatacgtgcacttgcttgttatgttttggaggtaaatgtgagcctttaattgtttcctctttaaatgcagccctaactattttgattgactccaagacttttctcctttaaatactctagtatggtatagaactacccaaaactagaggtcctaaatacttccagggccacgaggaagggacgggtagtgcacgtataggacgtttatcaaggttattagaacgctttaggctataaccaaggagaggaaattgggtagtaaggatatgatgactacgcgataatgccacgtgtagcccctcattgaggaatgattaccgagcattgtgtgggtatgatcatgtaggctaacaaacctaggacccctctttccaatttccgttattgaaataaatttactttcctttatatatgtgcaacatattcaaaccttttcttttatttcattacttgaatcatacatatgcttagaatgtcaaaacatgcctttatttgcacacacgtgttaaagtcgtctatttgttaaaaggactaattcacatagtttaagttcggtcagtacccaccattgtggaccaagaggggtgcctaacacctttccctcaaggttatttcgagcccttaccctaaatctctggaaatgcaaaccagtctaagagttaatcgctctagttgccctaacgcaccacaatccgttaggtggtgattcttcaaatacccaaatcccaaaaggaaatgagttattaccaccatgaatgtcaaaacccggactttctccgcggaggagaaaaggggggcgcgatatataccatgcttcaattggattaatttactgagattaccgtttagccgaaagaggaacatcaacttcaagtgcaatctgattatctgttgaattcgtgagaatcaatagtatcatagagtgaactaactcaagaattggatcccgagtcaatcatcttgcatctgtctagtcaattacccttatttctctcattgatatttctttgttgcccatcagctatccttcgagatcaattattaattgcttaatttttagtagttaatcgtagtaatagtcatcaaatcaagtgttaattttcctggatagtaatcaactgaagattattcgaatgccatttaaatccaatccatgtggagatgataattaaactatactatctttgactagctagcaataattttgtgttgtgttttgcgctcgtcgaagcttggcaaagattcaaggatatagtgagaaggtgtcaacataatggaattgaattgtggatacaacttcaggacttttgggatggactgacaccctcctcatgaggaactttgagtattgcatgtggaggtccattaatgaggaaaactccggaggagatcgtcctattcttaatgaattgtctaaggacgctaatcagtggcctgttgagggtaatgacaggagaaaatctgttggggttcatgtcacgccccaacccggggaggcgtggctggcacctggtgccacactggcccgagcgaaccactttgtaactcatttactttctttataaatatcatggcccatcatggcgacaactcataatgtacaactgtaagtgggcaaatgttataccaatgaaccatcgttcataaaacatgaatacataagggtcgtcaaggcctctgacatactatacaaaatgaacatctgtttacaaagcctctaagattattcgacattaaatgggaaagtgtaccggcctacccataagtctgtagaaaaactctaacacattgactcttagactcggctgcacttcgaatgaggtggagtcttaccgatcctttgctgaatgccaatctcatctactatgagggctcgtcaaactgattatctatacctgcaggcatgaatgcagtgtacccaacaaaaggacgtcaatacgaataatgtactgagtatgtaaggcaaaactaaaacataacaataagtcaacattaattaaagaaatggaataaacatccactaaatcactcaatctataagtctgggtagctctataaatcatgaaatatttatggtatcatgtatatgcatataaatgtcatgtaatgtataggtatgtacatacataacatcataaagcctttgagggaatcccatcatatcatctcagccactgtgggcaaaatcatcatcgtataccagctgatgaggtggtagtacatatataataccgtaacctttttccatatctcatatatatatatatatatatatatatatatatatatatatatatatattatatgtatatacgtgtatataacggaatctgagtgatgggtaaatgcacatgtataaatgaatgcaatgcataatgaagtaagtcaatgtgatctcttggaatgtcatgagatccatgaatagacaatatagtagtgggatacatgaggaatcaataacatagacaaccttagtacttctaagaatataatcatttgtgaaacttacgtatttgctcatttcgttatatcatatggatcataccaaaagaaagaagggataaccttaacatacctagaccaattctcctgacagtccttctaacaactctccgtgttttttcataagattaaaatatttgcaatcctgagccatctatacgaaacaaaaaaggcaatagattctcattgcttctttaccatctgctaaaccttcgaattcgtttgccttccatctaatcatttattaatacgatgctgatactaaaatacacctttgaaggcatcaatgataaattaacttgaaaaatcagaaagataaaaaaaagcctaaaattgagaggagcaagttctaaaagagcgagtactaagaaatcaaagtataagttattttctggctaatagtttaggtggattctctagtagctgagcacaacatctttcaactttctattaaatttgttttggttttttacatggagcagatcatgtgcctatacatatgcatttaattatgttggtaaaatccatccaaaaatgtgaataagtggaaagtggggtccacatctctcgccaccatattgaaagattgttacatgtggcatagatgttacatgttagtcacaagtcatttttagaggggaggggaagggtgactgcaacgttatgtcttagctaatcttttaattaatctctcactaaactcattaattacccaattatccacataattaagaattaactcaaattacttaaaattttaatcatttttaatactttatacaccttattataatatactttactattatggtcatgtagtactatataaattaaatatacacactattatttattataacatacatgtaacatacatatatttttttcaacttataatttgtctaatatcatataaagagtaaaaaatttcctacgcttaattcttaaaatggtaaaagataaaaaaattcttgtgagaaaataatttatatctttacaataaagaaaatcttataaactttctcatactatgtgtataatttaaaacatattcgaaagtagtaatattaataactgtataaaattatatttttcaaaccattgtttttctttacaaataaagttccactcaaaataccatatcaaagatatatatacaatagtatcaaggttgttaaatttacggggtgtaacatccttcccccctttagaacattcgtctcgaatgttaactgttagagatttgcaaaattttcattagggtctcatctgtaaaacaaacttatacccaaattgtatcggaagtctggactattcacaacttgctgtatttgagtatctcgtatcttcctaacctttaccttatctacctttcaatctcgcatcgtatcttgtatttcttccataacctccttcaacataggtggaaattacgtcttaaatctctactgtaatacacacacttctagtgcatacaaaatctggcaaaagcttcatactgacttcttacgactcagctctatggcacgatctagaaacaaaagaagggtgaaatttcctaattgtcctatagtctctcaattataagcccataagtgagactttactaggcacgactttgtgaacttcctaggacacgacctgctctgataccattttgtcacgccctaacctaggaaggcgtggatggcacccggtgttgcactgttccgagtgaacaactttgtaactcatttactttctttataaatatcatgggccaacatggacacaactcataatgtacaattgtaagtgggcaaatgttatatcaatgaaccatcattcataaaacatgaatacctaaggcccgtcaaggcctctgacatacaatacaaaatgaacctctgtctacaaagcttctaagattatttgacattaaatgggacagggtaccaacctacccataaatttgtagcaaaactctaacacattgactcttagtctcgggtgcacttcgaaagaggtggagtcttaccgagccttcactgaatgccaatctcgtctactataagggctcatcatactgattatctataactgcaagcatgaatgtagcatccccaacaaaaggacgtcagtacgaataatgtactgagtatgaaaggcagaactgaaacataacaataagtcagcattaattaaaaacatggaagaaacacagagtagaggactcaacatgtaagtctggatagctctataaatcatgaaatatttatagtatcatgcatatacgtgcaaatgtcatgtaatgcataggtctatatgtacataacatcataaagcctctgagggcatcccatcatatcatctcagccactgtgagcaaaatcatcatcgtatactagatgatcaggtggtggtgcatatataacgccgtaacttatcccgatatcccctatacatattatatatatatatatatatatatatatatatatatatatatatatatatatatatatatatatatatatatatatatatatatatatatatatacatacacatatataatgccatctgagtgatggataaatgcacatgtataaatgaatgcaatgcataataaagttagtcaatttgatctcttggaatgtcatgagacccatgaatagacaatatggtaggaggacacatgggaaatcaagaacatagacaatcttagtacttctaagaatagaatcatttgtgaacccctttgagcctataatcctatttctttggtaaccacattacaagccttacccatttgtttgaattaaccatctatttgaaccattgtaacctctcatgagcacttgaattgtttatgaacattgtaaaggttaaagtgtggggtggttggtttggcttttgagtggaactaattaaataagaagaaaggtgcactattttgaaaaagtaagagccacttgaataaaaaaaacaaaaatatagttggattgttgcgaaaataatttcttgataagtggtggctcttgatgtaagtgtgcttaaagaagaatggggtaatatatattgatgtgaaggtggagttttgttttgacataagtatggggtttgaatgttaaagtatatgtattaaagtgcttagggaggtgtagtcactcttatatctaaatgtatcctaaccgtcccgtagcctacattacaattaaaaaagtcctaattgatcctagattaaatgagctcgattagtggagtagtacactacgggcaagcttatagtgcatcttttgtggcatatgaatgttatttttgaaagtgagtgaattctttcgatcttgagttcctaagtgttcttaaattttattgtgtggaactactctcttttgttttgtgagggcacttgattcatgaaagaaaggtaatgtcagtggcctctatgttagagtaagtgggtgagttgtgactaatgtgtggtacttgtgagtcaaatcttgaggtgaatatgttacgcttttgtgcttagtctattttaaatactcttggtgcgatgagttaggaaaattatttaaaaaggtggtgtctataaattatagttgattgctcgaggacgagtaatgatttaagtgtgaggtattgatgataggttataattacgtattttagtcgcttattacactcaaatttactccactttaattgagtttgagctttaattgctagtgtcttgcactaattgtgtgttttatgtcttgtaggagtgattccgagctatgtagatgtcatggaatgaattcaagtgatttggagctttgaagtctgagtaaaagcccaaggaattaagctggtatcgtattcggggatcaacggatgatagagcaacaaaacgaataatcgagtaggtatattgcatactatctagtaaaatgcacataactttttcctcggaactccatttgggctccacaatatatagttataaagataactcaaagggataatactttcatgttttatgttttgccaaattcccaatggaacagggtaaaaaacacagtgaaaatcgcgattgtcgacctgaggcaggctgaggcagtacactaggaaagtaccacactcgggccgcggccgcagacgttcaagccttgaaacatatccttttttgcgtaggagaaggtataattgtttgggcccgaccctacttggtatatatacatggaaaacggtattttgaaggaggagaccaatttttgacatagattcgacctaaagaggcagagacacaataggagcaaggcgggaaattcttctacgagtttttccttcctcttcctatttttttcattatcgttatgacttttagtattgtggttttacatactattatgaatagctaatttgttatctagggttttgatagaaccttttgtaggataaattcttgttatgtttttatataattgagccgttggatttctctacttgttcaactatgtgtttgttgttgttgattgaatgaccatcaattgactatgcctatttagtgtgttgtgctcgagagagattacatatttaggtagttgttgaacaacgtcatcctaacatatgtgagaaatcaaaacagtgggcttaaaggcatgtttggaaataacaaagccttgacgtggtcataatgagcggttagataaagccaactagcatagttcgagagaatatatccattaaattgttgtagtttctcaagagagaattacaacatctaaaatgctcaggatcagaagagaatacactggcaaaattgcagggaacatagctagaaggattccggcaattaggaaaatcataattctagacctccttaatttagtaaccctttgtctcgttagttgataattttactgttttctagtatttactagttaattagttagaaatataaatatcaatatttataatatagaaaattgttcaaacttgtctttttagtgatattaaatagatattgctaagccttagttctctgtgggattcgactccggacttttagaccggattatatttgcagcgaccgcttatcctttttaggactagagttaggcatgatcactaagatagtcacattggctataccaggtgtgccacggattgagtggtgaggtgtgactgattatgttcccagtagagtgatatcattcttgacagctcagcgtatggttgggaagagttgtctttcgtatctagcctttgtgagggatgtcggtgctgagactcctagtattgattctgttccagttgtgaaggattttctcgatgtgtttcctgtagacctacagagcatgccaccggatagggatattgatgtcgccgtatcgtatggcaccagcggagttgaaggaattaaaggagcaactttaggaactccttgataaagggttcattcggcctagtgtgtcaccttggggtgtgccggttctatttgtgaagaaaaaggatggcactttgaggatgtacattaattataagcaattgaacaaggtgacaattaaaaataagtatcacttgcatcgcattgatgatttatttgaccagctttagggagcgagggtgttctccaagattaatctctgttcaagttatcaccagttaaagatcaggtactcggttattcttaagacaacatttaggacttgatatggtcattatgagttcttagtgatatcttttgggctgaccaatgccccagcagtgttcatgcatttgatgagcagtgtgttccagccttatcttgactcgtttttcatagtcttcattgacgatattctggtgtattcgcgtagtcaggagaaacacactgagcacttgagagttgtgttgcaaagattgagggaagagaatctttatgcaaaattctccaagtgtgagttttggcataattcagtgtatttcttggggcacgtggtgtccaacgagggtattcaggttgatccgaagaagatagaggcggttcagagttggtccaggctgtcctcagccatagagattcacagatttcttggtttggtgggctgttttgttcagggattctcatctattgcatcgcccttgaccaagttcacttagaagggtatttcatttgtatggtcagacgagtgtgaggagagctttcagaagctcaagacagccttgaccacaactccagtgttaggtttgccatcagcttcagtttcatataccgtgtattgtgattctttgagagttgacattggttctgttttgatgcagaagggtagagttattgcttatgcttctcgacagttgaatccccatgataagaactaccccgttcatgatctagagttggctgccatagttcacgcgttgaagatttggagacattacttgtatggtgtgtcttgtgaggtgttcactgatcatcgtagcctccaacacttgttcaagcagaaggatcttaatttgaggcagcggaagtggttgtagttgcttaaggattatgatatcactatattgtaccatctggaaaaggccaatgcggtggacgatgctttgagctgaaaggcattgcgtatggggagtttggcatatattctagttggggagagacctcttgtagttgatttttaggccttggacaatcggttcgtgaggttagatattttggagcccaatcgggtattggcttgtattgtttctcggtcttccttatatgatcgcatcagagagcaccgatatgatgatccacatttgcttgtccttaaggacaaagttcagcatgatgatgccatagatgtgaccattggtgatgatggggtgtttaggatacagggccgaatttgtgtgcttaatgtttatgggcttcgggagttgattctggaggaggcccatagctcgcagtattccattcatctgcgtgtcacaaagatgtatcaggatttaaggtagcactattggtggaggagaatgaataaagatattttaggatttgtagctcggtgtctcaattgtcagcaggtgaaatatgagcatcagagatcgggtggcttgcttcagcagatggatattcccgagtggaagtgggagaggatcactatggactttgttgttggacttccacggactttgaggatgttcgatgctatttgggtgattgtggatcagctaaccaagtccgcgcacttcattcctttgtgtactatttattcttcatagcggttgccagagatctatatccgggagatttttaggttgcatggtgtcctagtttccatcatttcagataggggcactcagtttacgtcactgttttggaggtctgtgcagcgagagttgggtactcaggttgagttgagcacaactttttactcagacagacaggcagtccgagcgtattatttagatattggaggacatgttgcgtatttgcgtcattgatttcggagggtcatgggatcagtttttaccacttgtagagtgtccttataacaacagctaccagtcgagtattcagatggctccatatgaggctttgtatggaagacgatgtagatctccagttggttggttcgagcccggtgaggcttggctattggggacagatttggtgcaggatgatttagaaaaggtgaaggtaattcaagagaggcttcgtacagcgcagtcgaggcagaagagctatgctgatatgaaggttcgggatgtgtcctacatagttggcaagaaggttatgttgaaggtttcacccatgaagggtgttatgagatttgggaagaaagggaaattgagtcctcgattcattgggccttttgaggtgcttcgggggattggggaggtggtttatgagcttgttttgccaccccgcttatcgagtgtgcatcaggtatttcatgtttatatgctccggaagtatattggggatcggtctcgtgttttggatttcagcacggtttagttagatgatgatttgacttatgatatggagctagtatctattttgggtcgtcaggttcgaaagttgaggtcaaaggatatagcttcggtgaaagtacagtggagaggttgacccgtagaggaggctacctggagaccgaacgggagatgcggagcagatatactcacccgtttgaggcttcaggtatatttcttgactcgtttgaggacaaaggtttgtttaagttggggaggatgtgacgacccggccagtcgtctcataagttatcgctccatttttcccatttctgcttctttatgttttgttatccgtattatgtggtatcgggctggtcgtaccaaatccagaatgattttggtaaggtttgagacacttagtctcttttgagaaagcttaagttggaaaagtcaaccggatgttgacttatgtattaaagggcttggatgttaattctgatggttcgactagcttcaggaggcgatttgggatttaggagcacaatcggaatgagttttggaggttcggagtataatttggtttgaattggcgaagttgatattttggcgatttttggttggtaggcgagattttgatgtaggggttggaatcaaattttgagagttgcagtagtttcattgtggcatttgggatgtgtgtgaaaaatttcaggtcattcggacatggtttggttgagttttttatccgatgtgttttggttgatttgatggtgtttgaggtgttttgaagattggtacaagtttgaataaggttttaggatatgttggttcctttggttgaggtcccgggggcctcgggtgagttttgaggggttgaacggatcatttttgagttaagaaaattaaagattttggtttcagttgttgaagatattttggtcttcgcgttcgcgagtggaccctcgcgttcgtgaagggtcaggaagggaggcgtcaggtttgtccttcaagttcacgaaggggagtcctgcgtgcgcaaagggccggaatggtatgcatcgcgttcatgagaggcctggttgcattcgtttaggttggtgaagctgaggcatcgcattcgcgatggtgaggtcgcgttcgcgaagaaggaatttaggcatggacagaatgtttaagtacttgtcttgtccgcgattttggggtttatttcttccattgttggtcgtttatggagatttttgaaggggattcaaggataatcacttggaggtaagattcttggacttaaaatacgattctaatgtgaattccacctaaataaccatagaaattatgtcaaaaattgaagaactagggcttgggaatttagacctttaattgaggatttgaaggaccatttaaggtcggatttcagaacttttaatatgtatgaactcgtggggagataaggaatctattgatgtaaaaattatcgaattccgagacatgggcccagggtcgggttttggtaatttcgggatttgtatcgtattttgattattttcgcttgggcttcgttcccttagaatattttgacgtcctcgttctgattttggatagattcgatgcgagtgaaggccgattcgaggggcaaaggcgtcgcgatctagagatttgaccggttcgaggtgagtaatgattagaaatgttgttctgagggtatgaaaccctcgagttgcacatcgttgtgctatattgagatgacgtacacgcttgatgacgagcgtggggtcgtgcactgttgggaattgtgacttagtccgtcctgaatgactattttaccgcgtatttgatcgaaatctatttgctatcatcatgatttgggttgaatgccatatttggttgttgtgccaactatttgaacccttcgaggatttgtattgatttttctacactgttttgactttatacttaaacccagttatgatatatttcactgttttcgtactcggccatgtttactatgttttaacacttaaatgatcttttaaatgatattttgggctgagaaacatgctttgctgctgcccgagtggcttgtgaggatttttgactgagtaaggccgagggcctatattgtgaggaaacatttgatactgattatgtggctgagagcctgagatatgtacgccacgaggtgacttgattaatatgaggccgaaggcctagtgatgatgccacgaggtggcttgatattgcgcttgggccgcaaggggcccctccaggagtctgtacacccccagtgagcataagtacctattgtgatatgagattgagcctgaggggcgggtattgttttatgtgattgcccgaggggctggtattgttctaagatgttgtccaaggggcggatttgttggtactgtgcccgataggcgaacctttctgtgtttattttcataattgattgtcaattatctgcttaattgttgaaaaaggcttttcaggaagtaaattttgagttaaaggattttacctatctttcactggtttactgtttttaatggttttactgcttcattatagcatgcttttgtgccttatgtgatttcctgcttttagtctttatttattattattactcactgagttggagcactcattttactccctgcaccctgtgagcagattcaggcgtatctggtcccgctcccgagtgctgatcatttccgactcaggaggatccgaggagtctctaggtagctattggcattcgcagcccggagctcttccctatcttattccttcctgttcttagtttctgtattaaactgtgtagttatatatatttggagtattctgttttgttagatgctcatgactagtgacaccccggtatcgggctgtggttgggttgtattccgcatattatagtatcatttgcttaaactttggttcatttattcatgtttatactgtttcttaatgcttaattgttacaaattggaaaatggaaagtgttggctggccttgtcttcacgagaggcgtcatcactaacgggtccaggtttagggtcgtgacacccgtgccctactcctggatgactgtgccctgagtctcaaatattttcatctgatttgttgatgaacgctttcatgaaatattccttactggactgatttgattgatgtggctagtattgctgcctctattggttctaaaaatctggtggtccttgaccctagggtctaggattatttcgctgtcgtgagttcaaacttagtgaactcaacgaaaaacctagatgtctttgccccatagcattagttgttcctaccttggtagtgtcacgacccaaaatcaactaagggtcgtgatggcgccggacaccactgtcaggcaagccaactacaattcactagcaatttctcattttagttattttgaaacatttttttaaaacaaataaataataaataataaaccccacttcacaaatgaggatgtctttacaaaatttaactactgaaaaatcccgtgattatcccagaacccggtgtcacaagtacatgagcaatttctaggaaaaaatgtaatacagcaaccgcccggaatgcaatattggacagaaagtaaatacaaaaattcgaaagagactctgctggctgcgggtagtctcgagaagtgcaacttacctaattctccgtatcaatcatgcttctacacccattaggccactggggatgtgtgtacctatgcaaaaaaaatgcacagcaagtgtagtatgagtaccgaaacgacgcgtacccaatgagtatcttgtctaatctcgaagaagtagagacgagaggtcgacttcgacacttacttgtggtccaataataatatttgtaaaaattggaggagatcgtggattctataaagcaattataaactcataaagccaggtagcaggtagacaacttcccaaataataatggatttccaaagatttacttttcatcatctttataaatttatctccgaccgggaaaggcaaatatcaacatttataaatctcagataataatacaatcttgcgcatatcatgccgaggtcgtacggcccgatccaacataaatgtaaaatgtgcactgtcgagggccgaacggcccgaaccatagatgtatctattaccccatcgcgaatcatacaacgacgcgatcaacataaataaacaaataccctactcgcgaatcatacatgtgacacgggcacacatagatacacacattcaaacaatcaattaaaaatttatcggggaatgtttatccaaataaaagccaattatcttttaatgatttaagaaaaatgaagtttaatccttttagaaattcattcaccaattcgataggatttaagcaattcaactatcaataagattacaatttattccaagtatagcatgcttttgggtcctagacaacccagacttaaacatgatagtagctacacacggactctcatcacctcatgtgtacgtagcccccaaaaataggagcacataaccaattattttacctttgaggacaattccatcttacaaggttagaaaggagactcacctcgctccgaagaccaataaccggcattccacgcccttccaaagactcgaatcgattataaatgctccaaaactagccaataattatgcaaatccatgagtacattttcaactacccattacaatccaatttataataatttctaacctcgatcaaaatgttaataaaattgccctcgggcccacgtacccggatttcaaaatttctcgaagataaagtttacccacaacctcacgaactcaatatattatctactctcaatttcatacccaaaattgtggtcaaaatccaagaatatcaattttctaggttttactcaaacccccaaatttctaccaatttacatgctcaaatctgaaacaaaaccatgtatttaacgtctaatgagtgggaacaacttaccttgacatagatgaagaaaatgtctcttccaaaagctctaaaatcgtccaactcaaagtgaaaatgtgtggaaatgaaccagactcgatttttaaagagagctcactgactctagtcctttcgcacctgcagtcttttgaccacttctgcggtcccgcaagtgcagaccaaatgcctcttctgcggtctggggctcccagcccatttccgcttctgtgctccttctttcataggtgcggtcccgctcctgtggtgacctgaccgcatctgcggtcccagtcttcacccttcaccaccacatctgtgccattttggccgctgctgcggctccacacccgcgagacttgggccgcaggtatggttacactaggaaccagcaacttcagctcttcctccaagttccaatttgatctgttaaccacccagaatccacccgaggcccccaggaccccaaccaatcataccaaccaatcccaaaatacattacggacttgcccgaggccttaaatcatatcaaacagcagtaaaatcatgaatcgacctccaatccaagcttaatgaactttagaattttaaactcctacattcgatgctgaaacctatcaaatcacatctgattgacttccaattttgcacacaagtcacatttgacattacggacctactccaacatccggaatcggattccaaccccgatattaaaaagttcacttccggttaaactttttaaaaactttcaaatttcaatctttagccaaacgactccaaaatgacccacggacctccgaattcacttccgatcgcgctcccaacaccagaatcactatacggagatattcccaggctcggaatctcaaacggacattgataatactgagatacacttcaacccaaacctatgaaaattgctccaaaatgctaacttccacaataggtgccaaaacgttcacgggtcttccaaaacccgatctgtacatatgcccaagtcctaaatcatcacatgaacctattggaaccttcaaatcccgattgcgaggtcgtttactcaaaaattcaatcttattcaattcgtctaacttaaagcttctgaaatgagaattctctttccaattcaaccctgaacttcccaaaattcaattctgaccatgtgcacaagtcataatacctgaagtgaatctactcatggcctcaaaccgctgaacgatgcactagaactcaaaacgaccgaccgggtcattgcaggtagtattctctattaaagtttcctatcgtgtttacttcctcaagtgaagcttgaaactcaggtgtggagtgtcccattccacaaaaatcacatgctgcttgcggttcactctgtatcttgggcaatatcaactttttttctctttgaccatggtgtctagctgggtttacactgatgtgttaaagtccacctggtgaactgttacacctcgtaaatttaacaactttgataccgttatatatatatattcgatatggtattttgagtggaactttatttgtaaagaaaaaaattggtttgaaaaatatgattttatatagttattaatattactactttcgaatatgtttcaaattatacacataatatgagaaagtttataagattttttaattgtaaagatagaagttattttctcagaagaaaaaaaggctatctttttaccattttaagaattaagcgtacgaaattttttactctttatatgagattaaaaaaattataagttgagaaaatatagggatttttgcatggatgttataataaaataatagtgtatgtatttattttatatggtactacatgaccataatagtaaagtatattatagtaaggtgtataaagtatttaaaataagcataattttaagtaatttgagataattcttaattatatggataattgaataattgatgagtttagtaggagattaattaaaagattagctaagacataacgtgtcagccctcctccaaaaatgacgtgtgactaacatgtaacatctatgccacttgtagcaatctttcaatatggtggcaagagaggtgtaccccactttccacttattcatattttttgatggattttactaacacaattatatgcatatgtacagccacatgatctgctccatgtaaaagaacaaaacaaatataatagaaagttgaaagatgttatacttagctaatagaggatccatctaaactattagccaaaaaataatttattctttgatttcttagtactcgctcttttaaaacttgctcctctccattttatacttttttttctttctgatttttcaagttaatttatatgtgatgctttaaagctgtattttagtatcagtatcatattactacatgattagatggaagcagacaaattcgaaggtttagcagatggaaaagaatcaatgggactctattgccttttctatttcgtatagatggctcaggattgcaaatattttaatcttatgaaaaaacacagagagttgttagaggtattgtcaagagaattggtccaggtattttaaggttatcccttcttttttttggcatgatccatatgatacaacgaaatgaccaaacacgcaagtttcacaaatgattctattcttagaggtactaaggttgtctatgttattgattcccaatgtgtcctactactatattgcctattcatgggtctcataacattccaagagatcatattgacttacttcattatgcattgtattcatttatacatgtgcatttacccatcacttagatggcgttatatacgcgtatatatatatatatatatatatatatatatatatatatgatatgggaaaaggttatagtgttatatatgcaccaccacctgatcagctggtatacgataataattttgcctacagtggctgagatgatatgatgagatgcccttagaggctttacgatgttatgtacgtacagacctatgcatcatatgacatttatatacatatgcatgatactataaatatttcataatttatagagctatccagacttacaggttgagtcctctactccatgtttcttccatgtctttaattaatgttgacttattgttttgtttcagttctgccttacatactcagtacattattcgtactgacgtccttttgttggggatgctgcattcatgcctgtagatatagataatcggtttgacgagccctcatagtagacgagattggcattcagcgaaggatcggtaagactccacgtctttcggagtgcacctcagtctaagagtaaatgtgttagagttttactatagacttatgggtaggctggtaacctgtcccatttaatgtcgaataatcttagaagctttgtagacagaagttcattttgcatagtattttagaggccttgacgggccttatgtattcatgttttatgaatgatggttcattggtataacattttcccacatacagttgtacattatgagttgtggccatattggcccatgatatttataaagaaagtaaatgagttacagagtggttcgctcggaacagtgcgacgccgggttccagccacgccttcctaggttggggcatgacaaagtggtatcagagcaggtcgtgtcctaggaagtccacaaagctttgcctagtagagtcttacttatgggtttgttatacaccacgtttataatttagaggctatagggcaattcataaatgtcacccttcttttgtttccagattgttccatagagctgagttataagaagtcagtatgaagcttttgccagattttgtatgcactagaagtgtatgtattacagtagagctttaagacgtaatttccacctatgtttaaggaggttatgaaataaataaaagatacgatgcgagattgaaaggtagataaggtaaaggttaggaagatacgaggtactcaaatacaacaagttgtgaatagtccagacttcagatatagtttgagtattggttaatttacagaggataccctagtgaaaattttgcaaatctctaagagttaacattcgaggacgaatgttctaaagggggaaggatgttacaccccgtaaatttaacaaccttgatacaatatatatatatatatatatatatatatatttgagtggaactttatttgtaaagaaaaaaaatggtttgaaaaatataattttatatagatattaatattactacattcgaatatgttttaaattatacacataatatgagaaagcttatgagattttctttattgtaatgatagaaattattttctgacaagaaaaaaaggttatctttttaccattttaagaagcgtacgaaaatttttattctttatatgagattagaaaaattataagttaagaaaatatatgtattttacatggatactgtaataaattaatattgtatgtatttattttatatggaactacatgaccataatagtaaagtatattatagtaaggtgtataaaatatttaaaataagtataattttaagtaatttgagataatttttaattatttgaataattgggtaattaatgagtttagtgggagattaattaaaagattagctaagacataacatggcagccctcccccttccaaaaatgtcgtgtgactaacatgtaacatctatgccacttgtaacaatctttcaatatggtggcaagagaagcgaacctcactttccacattcatattttttgatggattttaccaacacaattatatgcatatgtacaagcacatgatttgctccatgtaaaagaataaaacaaatttaatagaagttgaaagatattgtactcagctactagaggatccacctaaactattagccaaaaaataatttatactttgatttcttagtactcgctcttttagaacttgctcctctccattttaggcttttttttctttctgatttttcaagttaatttatatgtgatgctttaaaggtgtattttagaatcaacatcatattactacacgattagatggaaggcagacaaattcgaaggtttagtagatggcaaagaagcaatgagactctattgccttttctgtttcatatagatgactcaggattgcaaatattctaatcctatggaaaaacatggagagttgttagagggattgtcaagaaaattggtccaggtatgttaatgttatccgttctttcttttggagtgatccatatgatacaacgaaatgagaaaatatactcttccttaatacaaaatggcgatatgcagataatgtacatgtccataatgctttgtatactcttgtaaggccatacgttgagttaaattcttgcaagtttgtcctctatttatgagagaatcttggctggaatccacgacgatttaaactccccataaacccttacattcgaggacgaatgttcctaagggggaagggtgttacaacccatattcacacgcgttagttcatgccatatattagttaacataaatccaagaagtaattacctttgagatgataagaagttaatcctattggtcttaagtgatacaagggtatacaagggtgattaacaagtattagaagttaaacgaatcaaggatgttgtaactcgtattttcaggtaaacctagaggttattaatacactcaagaggtcatgtattaaggtgtttgaatcatataatatccatatcataagtcttgaagtcaaatgagttatgaaacaaaagtcgacaaacgttgtcgcaacttaggttcataattttacttaaacattaggtcaaatgtttctacacttttctcctaatttacaagtaattacggggtgatatacccaccaaattaaatatatatgagtctagtttctaactcattaaaccgtttgtcaatacgatctcggagtatagagatattcatattttcgcaagcctgtgcagattggtagatgacaagtagatgcatcacctacttgccaaaatgataggacaaaattaaaagacctaagtcggacaagagagaaattttaaggggttatgaactcagttatttcatctatattttagaccctcaaaaccaaagttaacccctgcaactcctccccaaaaatcccatacaaaccctaatcgattttccttctctttcaagttctatttgaaggtaaaacctatagtttgaagaaccaagggaagggctgagttatccaacaagtaaggtaagttactgacatctttcatacatttttctcttctctgaattcatggtaattcattctatacatgtaagaactcacgggatggtgatcgaaagctgtgagtttgagttatttacttgtagcggactgttctgtgttgctgttgggatgcgtgttttactaatgttttgtggagttttggaggtggaagagtgtggagaaataccatatatatgtagggttgttggctgatagttattcataatattttcgggttgtttgacacgactacggtggccatcgtatgtatgatgtaattaggttgtgcgtgcactgttttgggaggctcaatatgtttattattgatgttgtttgggctgtttggtgattgttttgaatggtgtgaagtcatatctataggggaggtgctgtccgtttcagcataaaataggttgtggtcgatacataatagttatgacgcttaaatgataacgatagtatcgtttctcttgttgctgactaaggagttgtgacaattgcatagcttgcgattggggaaatatatacaagttatgtgaggctatccttttccttcttttgcatgactccgattgtacaaaatataatgaacgagcttccaaagatactctactcttagaagctagcagtacttacattgctttccctcttatggaacgattgatgttaatgttgcttctcttattcttatgttatcaatgttgttggtacttcctgattcttataagggtcatagtgaagagttaatcctaataacggcacacaggatatcgaccttacttcactccgaaaggtttagaatgtgattccatgagttgagcacgcattatatatatgtatctattttactctaccgagccgcgctatagtcgatcgggtgtggcacctattttgaaaccacttatcagttgggttttaccaagctccacatggccgggtacgattctaccgagccttatgatggccgggtatgtttttttccgagcctattacgactgggtacaatatgatgatgatgatgcccgcagaggcgtatgttttaaaagtttatgtatacatacatatgtatcatgcattacatgtcagtagccctcagaggtactcagatgttccaggttgtatattctctatccctggttacattactgttcgtatttatggttccatgccttacatactcagtactttattcgtagtgacgtccttttgtttgtggacgctgcatatcgtgctgcaggtcctgatagacaggcaggtgcagctcccccaccacagtaggttgtccagttcagcagtgattggcgagatcccttctccggacttgacgtagtcttggtatgcattttgttatagacattatgggtatgtcagggccctgttctggctatgctgtagcacttatgttcatttagaggctcatagacatgtgtcgactcatgtatagtttggtatgccttgtcggctggtttttgttatatcgtctttcatggtagcgtggtagctcgtaccttatatgtattttcttgattgtctgttcattccatgttatgtatgttcatgccatcatattttattgttggttttccatgatccatgtctaccatttatattgatcttgtcaaccctaaaagataataaaaaaaggttagataaaatgtacgttggtgctcggcaagtatggtcgggtgctagtcatggccctccagtttgggtcgtgacatcttgaaactgagaatcaagtggttgatgaggatgaactaaaagaggaggcttctaagcctagtgtggaattgaaagtcctccctactcacttgatatatgtttttcttgaggctaacaattttttgtgattatttctgcttacttgataggtacataggagcaaaaactggtggatcttcttaaaaagaacaaaaggccattggccggagtatagctgatattcaaggaatcaatccatccatttgcatgcacaaaattctactggaagaaaatagcaagccagtggtgcagccccaatgcaaattgaacaaaaatctggaggatgtagtgcataaggaaatcattaaattggaagatacgagagtgattttccgcatctctgatagctagtgaattagtccagtgcaagttgtacccaagaaggggggaatgacagtgatgaagaatgaagataatgaattcatcccaacacaaatagtcacagagtggagaatgtgcattgattatagaagggtgaatgatgcgacaaggaaataccatttcccacttctctttattgatcagatgctcaaaaaaagtggctggacatggatgctactatttcttggatgggtactcaggctataatcagatacccattgccccagaatatgttgaggaaactacattcacctgcccttcaggtatttttgcttagaggagggtgccatttgggttatgtaatgtatcggccacttttcagaggtgcatgatatctatattcaccaatctaaacgagaagtgtctagaggtattcatggatgattttaccctctttggtaatgactttgatgattgcttgatgaatttggagcttgtgcttgaacattacaaaacaactcacctgattcttaattaggagaagttccacttcatggtaaaagatggaattatcctaggccataaagtaactgcacacgtcattaaagttgatattggaaaggttgatgtaattgctaggctccctccaccgacttttgtgaagagcataaggagtttcttgggacatgctgggttctataaaagattcattaaaaacttatccagcattaccaagttgttgactgcattgccagcgaaggatgtcaagttcgttttcactatggagtgcttaagagcattggaattgattaaaaaaattgtgagtactcctattatggtgacacctaattggagccaaccatttcaaataatttgtaatgtgagcgatatagctgtgggggcagttctggggaaaagaaaagataagttgtttatgcacatctactatgcaagtaggacgttgaaagatgctcaagtaaactatgccactactgagaaagagttctttgttgtggtctttgctattgacaagtttagatcatatctagtggggagtaaagtgattgtacacactgatcactcgtcacatcagatgcggtgtgtttttaatccaagagtttgacttggataccaaagataggaagggcacagaaaatcaagttgcagattatctatctcgatatgagagaccttaggtgagacaattgaaataaggaaagagtttcatgataagcagattttctgcattgttgtcgtctctgaaagaccgccttggtatgctgatgtagccaactttttggctagtggatggttgttgtgtgacctctttcgtgatcaaagaaggaagctttagggtgaggtaaaaagttatttttggaatgaccctttgttgtttaaattgtgtgcagatggtatgatatgaagatgtgtgcttgaaacagagatggcaattattatttctcattgccatgatggagcggctggaggacactatgttggaaatcatactgcaaaaaaggtcatagaagccaatttatacaaagacgcacgggcatagtagttgtatgtgacaagtgtgaaaggccaggtaatattagcaggagggatgagatgctgaatccattcaggtatgtgaaatttttgatgtttggggcattgaattcatgggctcgttcccatcgtcttatttatacgagtatatcctagtagtcgttgactacgtttctaaatgggtcgaagcaaaccatactaggaccaatgatgcttgggtggtttgtgagttcttacgaaagaacatctttgcccgctttgggatacctcgagtgatcattagtgaaaatgggtcacactttgtgagtaagtagtttgttgcactgctgtccaagtatgggatcacacacaaaataggaaccccataccatgcccaaactagtgggcaagttgaagtggctaatcgtgagcttaaatgaattcttgaaaaaatggttagtgcttctaataaggattggtctatgaagttggataaagctctatgggtgtacataattgcgttcaaaacaaccataagacttcactattcaaattagtacatggaatatcgtgtcatctacttgttgagatagaacataaggcttattgggcaactaaaatatttaatcttgatcttagtcttgtaggtgaacacatgcagatgaacgaattggaggagtttagacaggaggcgtatgaaaatgcatgaatctttaaggataagacaaaaatatggcatgatcacctgattaagccaaaggaatttcatgaaggggacaaagttttactatataatagtagccttaggttgttccccggaaagtttaagtcgagatggacatgttcatatatagttaatcaagtctcactgtattgcgccattgagatccaagatgagaaagagaatgagagctttaaagtgaatgggcaaagattgaaaccgtaccttgttggacgatttgacaagcaatactctagcatcgtaatcaaatgagcctaagcgaagatgtcaagctgacgattataactcataactacttctaaccttttttctttcttttgtagaatagtttatataattgtagattaagattattatagtttaggagttttgatacttatttggacagttataagcatgaattggacacaaaataaatatataatagagagaggggagtgcaacccttgagttaaaaatcgaaaacaaggtgaactctatgaaaaatatcctagcgtgccacttgggggcgtcgtgctctgcgccatgccagtccaaatattctctctcttactccaaatctcttcttcttcaaaattttccactcaagttctcccacttccatgagtcatcaaggtaagttcttcttctcattttttatttttttctttcttatcagttagatgtagaattaaatagttttagtttgatttccttaaccctaggtagttgatttttgctaatctttaagttaatttctttttaattttggcggaaaattgtgcttaaacttgtgcgtttttcattgttcttatgattgtggatgatttgtggtatgttgtggtggcattggagtattttgtgataaagtttggcggggtgcctatatgaccgaaaattggtgaatattgtgtaaagttttagagcactttgttattgttacaatatggtgatgttttggttattgttgggtggttgattattgtataagtgtggtggttcttcaccatgtggagttgaaaataaaggggtgaacttagtgcctacaatgtgtttgataaaataccttattgaaaaaattgtgaagtttgttggttaattagggtaaatgaagaaccgagaaaatctcagattcatgccataatgagatgaaaaatgaacatagatggaaagaagcaaagatctgaaccagatttggttcaaaataggagagatcaggttgccatgttaggcaagaaattatgtaataccataaatgtcacgacccatttccataataggtcataatggtgcccaaccccattgccgggcaagccaacgcggaacaataccaaataagctctcattttacttttaccaacatacttgcaataattccttaagttaagattagaacgagtaataaccagtaatgtaccaaaaataattatacaatccccaaaagaataatctactaatgtgtgtgccaagatctggtgtcacaagttatgggcaactagtagaatatacaaaagaatcaatctatcctactgtacgaaataaaatagatagcaaaagtgaataagagacactccatctagttgttgaacgatactggaagggaagcaacacaccgtagaagtctcgaaatctgctcaggaatgcacaccagactgataaccagaggtacctgcctcagatcctgtacaattaagtatagaagtgtagtatgagtacataaacaatatgtacccagtaagtataccttgaaatctcgaagaactagagacgagaggtcgacttgatacttaccagggtcaaataatatgagaaagaatttatactaagcatggatagtacaattaattagcatttcatggcaagaaataatggttcctttttcctgataatatcatagttaaccatttgaattccaaggcatatacgaagttcagtccacagaaaaatactaagtaaaatatgtgcacttaatgctgagggtcgtacggcccgatccaacataaaagtaaattttgcactgtcaatggtcgaatggcacgaaccatagatgcatctattaccccgatcgcgaatcaaacatgcgatgcagtaaaatataaatatcacaacaacaagcagacaatggtgtatatctgggaaacaattactcacagaaataatcaatttctctttaaaaggccaagaaagataatgttcctcttactagtctcatttactctaatcaacatgatttatacaaatccgagttaaacatgaacttacaagaatatcacatagagcatgcttttgggtcctagactacccggacttagcataatagtagctacgcacggactctcgtcacctagtgcatacgtagcccccgcatatagtagaaatttattcaattattatacctatagggacaattctctcttacaaggttagaaatgacacttacctcgctccaaattatacttccaattccaagaacgagcccaaactctcaatttggagccgaacgatccaaagctagttaaatgagataggacctagtcaatataagctcacaagatcgtatgctagctatttaagcaatttcccaacccttaacactagtttcctaaaatccgaccccaagcccacatgcccggattccaaaaattttcgaagaaagttgttctctgtaacctaaggatcaataatatatgatccccatgattttacattaatcctagtgtttaatctacctaagacacaagtactaaactaggaatagatggaataaacttgcctcaaggtgctaggtgaaagttttctctccaaatctccaaaatcgcccaaatgaggagtgaaaagtggcaaaaatgacttaggacccatattaaatgaagctcactgctttagcgatttctgcttcaacggtcaggggaccgcatctgccgtcccacttctgcgaggaagaggaagcatctgtggaaatggtccaaacgggctgggaccacttctgcggcttgggagccgcttctgcggtctttgctggtctgcctttgccgcatctacgagagggcgatcgcttctgcagtctcgcacctgcggccgtccaaccacaggtgcggttatgacagataccagatgcttcagccctttgcaacttttccagcttcacttgagcctcgtccgattgatgctcggggcttccgggccccgccgaaacatactgataagtctgaaatcatgaaacggacctactcgaaccttcaaaatgcctgaaacaatgctaaatttacgaatcaccccctaaaaccaattgaatcaaacttatgaacttaaagttcttaaattcacttctatcgtgcctaaaagtacttatactactcggattgacaccaaattttgtgggtaggtcttaaatgttatattggacctgtactaggctccgaaaccaatataagagtatgataccaacgtgatcaatcattaattagtttctttaaattcttaaaatttcagtttaataatttctaataaaaattcattactcgggttagggacctcggaatttgatcccggacataagcccaggtcccatattttcctacggaacctccgagaccgtcaaaacacgaattcgggtccgtttgctaaaaatgttgaccaaagtcaaacttagccttttaaaaaaatttaagcaatcaaatgagcatatttcaacccaaactcttccaaatcccgaaccaaccatccccgcaggtcgtaaattagttaaagcaagcacgggaagttttttaagggaacgaggttctaaaaagcaaaatgagcagtcgggtcgttgaatgggtagccagtagcaagacaatatgaacaaggtaagaagatcattgatggatttcatgtctgagttggaatcaaagaggaaatagggttacactgcttgggttttaagaagagaagaggaagagatgagagaatatagaggcagcgggtttgggtgaatgagagttagggttaggagtttggttaattaaaatagggaaaagggatgtgggtcgttgatcttgaaagatcaacagcgtgatttaaaggtgactggggcgggttataatagacgggtaccgaccggatctagtgggttgggttaattatttgggctaggtattttgtgctggtgtatagttttgggcttgtgtattggttagttttaggtccgaaaataggagtaatttagggatagtttttaaatacccaacatttaataaataaataattgataaaagcgattaataaatattaaaaatattatatgtgcactaaaatgattaagagtaattatttaatattataaaaatataaaaagttattttctgtataaataatgtaattatacatgcatatgggattattgtaaaatgagcaatttagccttaaaatataaatataattataaaaatgcactgagaaatatttaaacattatgctggtaaaaataataagtttagatgtttaactcatgaaaccggagcgaagactgctcccgtttgaagaacagttacttcttggattacctgcaaaacttaaaacacgatgcatgcaaatatatatggattaatgcgagaatttaaacatgatgcagactccctttggatcatgaaggttgtctttggacagtgaggatgatgtccttagaccaagacgtcctcgccatgaatcatgagataagggattcacaggccatgaaatgatgttctcgagccatgagaatggtgcctcggaaccatgactcctttgaataatgacgtgcaatactgagagatcctcaggcatgacatggtgtcttcaggctatgaggatgacgccttcagactatgacgcctttggacaaattggctatatatcagcccatgagatgcagtgacatgatgcttgatataaaacaagatagagcttagtcttgtgcagggacgggtgcagagcttagccccgaaagaagtgaataatgcatggtttggaatagatcaacatttgtgcagagggagacaatgcttagtcttatgagaaggcagtgcttagcctaatgcaaatagagaggcagaggttagcctcacgcaagaattgagacaaagcttagtctcattaaagagaaggcaatgcttagccttatacaaataaggaggcagggcttagcctcatgcaagatttgagacagagtttagtctcatgcaatgagaaggcaatgcttagccttatgtaagcagcgaggcaggacttagcctcatgcaggaatcgagacagggcttagtctcatgcaaagagaaggcaatgcttggccttatgtgaataaagaggcagggcttagcctcatgcaagatttaagatagtgcttagtctcatgcagagggaaggaaatgcgtagccttatgcaaatgaggaggtatgccttagccttatgcaaatgaggaggtatgccttagcctcatgcaaaaattgagacagggcttagtctcatgtaacgagaaggcaatgcttagccttatgcaatcagggaagcagggcttagcctcatgcaggaatcgagatagggcttagtctcatgcaaagagaaggtaatgcttagccttatgcaaatgggaggcagggcttagcctcatgcaggaattgagacagagcttagtctcatacactggacaaaatgcaagtaggagcaaaatatttcttaactggagatatatttgtgcttggcagtccggttgttatgaaggtgatgattttaaggtgtgcatgcttgtggttattccttgttcttgcgtccaaagaaaattgtgagttttgcgggtgaggttggttcgtgcctttatcttcttatttttctttgctttgctttggagattctgtttgagttgccctgggtaacatctagctaccatagaaataacgttttcgagaaaaatatgcacttatttgatgaaatagagttatttagaaaatatagtggtatataatatcatataaattagatgaactaacgactatgacacttttagagacattgcggcctctttgcattagaattttaagggtcctcctcaaaattctttcctagtttagtgagcgagccttcgatcgttctacatgtgatgaagtttgttggacctgctccaaaattttgagattccttctcaaatttctgccccagttacttaactaattctctgactatcttacatatgatgacgtcgactggacttgctccagaattttaagggtacctccttaaaattctgtcctagtttttggttgtgggaaaatgaaaattttattgagatgtgaccgaacccacagggctgcctacgtatcctctcttaaacggaaatcaggtccaacgtagttcagttacattagatgaagaaatataaataatttaaatatagtatctcttgaccgcatccgaattgataggctttggccaaacttctctgtccatttctgcaagtatgagtgctcctcctgttagtaccttgtgaaccatataaggaccttgccagttaggtggaaatttccctttggcatcatcttgatatggaaagatccacttcaacaccagctgtccctagtgtgaactgtcttggtttgaccctttggttgaaagctctcgacatcctattctgataaagctgaccatgacatactgaattcatcctttttctatctatgagggataattgctcaaagcgactccttatccattctacatcactgattttggcttcttatacgatccttaaagaaggaatttctacctcggcgggaatgacagcttcagtaccataaaccagcaagtagggagttgcccccgttgatgtacgatttgtggtacggtatcccaataaggaaagtggtaacttctcattccattgcttgtgattctctaccattttccttagtatcttcttgatgttcttattggcatcttccacggctctatttatttgaggcatgtatgttgtggagtttttttgcttgattctgaaagtttcacacatggatttcatcagatcactgttgaggttcgcggaattatcagtgatgatagactcaggaaccccgaatcaacaaacaacacgatccctgacaaaatctgcgacgactttcttggttaccgctttgtacagcgcagcctctacccattttgtaaagtaatagattgccactaaaatgaacatgtgcccgtttgaagtagtgggttcgattggaccaatgacatccattccccaagcagtaaaaggtaaaggtgcacttgttgtattgagtttgtttggtggcacccatatcatatctgcatgtatcttgcattggtggcatttctggacataccggacgcaatctgtttccatagtcatccaaaattatctggctcggagtatcttcttaactagaacaaaatcgttcttatgtggactgcaagttccggtatgcatttcctcgagcaatttggaagcttctttggcgtcaacacaccttaatagtcctatattaggtgttctcctataaaacattcctcctcttggaagaaattattggacagcctatgcaatttccgtttctgagtatggtttgcctactctgggtattctcctttcaccaaatattccttgatatcgtggaaccatgggtttccgtctgtttcttcttcaacataagcacaataagttggctgactatggatctttactggaatgggatagatgaaattcttgtccggatgctgtatcatggaagacaaagtggccagtgcgtctgcgaacccgttttggactcttgaaacattttttaattctattttcgtgaacctcttcatcagttcttgcacatgacacaggtatggtagtatcttggtatttcttgtcgcccattctccttgaacctgatgtaccagaagatccgaatcaccaattaccaacagctcctatatatttatgtcgatggccaaattgagccccatgatgcaagcctcatattttgtcatattgtttgtgcatggaaacctatgctttgcggatatcggataatgttgacctatctttgacactaaaactgctccaatactcactcctttgaagtttgcagctccatcaaaaaacattctctaactgtcataggcttcagcaatgtcctctactatgaatgacacttcttcatcaggaaaatacatttttagtggttcgtattctcctcttacatgattttcggcaagacggtctgccaacacttttcctttaactgccttctgagttacatagatgatatcaaactcactcagcaatattttccacttgtccaacatcccggtaggcataggcttctgaaagatgttctttagaggatctatctttgatatgaggtatgtggtataggcgcagaagtaatgcctcaatttctaatctatccatgtcaaagcacagcaagtgcgttctagcagagagtattgtgcttcataaggtgtgaacttctaactcaagtaatatatggcttgctcctttcttcccgtctcgtcatgttgtcccaaaacaaatcgaagccccatctaatacagagatgtagagtagcagtggcctaccatgctctggtgggactaggactggcggtgtggacaggtattccttgattttgtcaaaagacttctgacaatccttagtccaattggttgcagtatccttcttcaatattttgaagattggttcacatattactgtggactgtgctatgaatcggctgatgtaattgaggcatcctaggaaactcatcatgtccttcatgttcttcagtggtggtaattcttggatagctttaacctttgacgggtccaactcgattcctcggtggctgacaattaatcctaacaattttctagcaggaaccgaaatgcacattttgcggggttcaattttaaattgtacttctgtagccggtcaaagaacttcctcaagtctgctatgtaatttgttgctttcttggatttgatgatgacgtcatcaacatatacctctatttccttgtgtatcatatcatggaagatggttgtcatggccctcatataggtggccccagcattcttcaaacagaatggtattattttgtagcaatacactccttattgtttaatgaaagctattttctctgcatcttcttcatccatccaaatttgatgataacccgtgaatcaatctgcaaaggattggagttcatgcttagcgtaattctcgatcataatgtgtatatttggcagtgaaaaatcgtccttgggacttgctctgtttaaatcccgatagccaatatacaccctgacttttccatctttcttcggaaccggtacaatgttggctaaccaggttgggtactcaactaccttgaggactttggctttgatctgcttagtgacttcctccttgaattttaggctcatgtctggtttgaactttctgagtttctgcttcaccggcggagacattggatcggtaggtaacttatgaaccactatggatgtgctcagaccggtcatatcagcatatgaccacgtaaaaatatcctcatattcttttaagaaatgagtttattcttccttctctaatagcgacagtgaatacttatgcgagtttctttgatggtttcagaatctccaaaattgactttctcggtttcgtccaggttggacttaggcttattctcaaaattttcaacttctctgataacttcctgaggtatctcatcttcttcttccgagtcactatccttatgttgtgtgcctcattacatgtcgcagtcattggttcatcaaggtaagaaatagtaatattgtagaagaaaaatatgaaagataacgataataaaacaccaaattatttgataaaaacgttaaacaaaatatcgtctagatgacttcaaacaatgttttccaaaacaaaatattgaaagaaaagttttttcaaaactaaatgctcaaaagacttgtttttcacataacattagtatccatgctaccccgggactcatctggaccttgatggtggggcggtccagtttctaagaaatgctcccctctttactgtctatatggttaggccttttactcctcctcctcaattatcacattgcaatccatatcttcgtcttctagaaacaggttccttagcccagccaaagcttcttcttcttcagatccccatattttatcggcctgataaaagatctgactcagatgtggcactggctgctcaagagggtaatagggaccatgccatggtggcgaccaatcatcatattcttgctatgtatacggatattcgttcccaaaagttgtaccatgacgttttaattgtatttgtttggtaatgccctggagtttcttcccaagccttttgccgggtttgtaccttgaccatgccagtatgctttctattttgttacttcaccatttatctttctcaattgcattgacatgctcgatgcggtgataagtttctccacccagctctcttctattctcgacaaccgggatggtttgactggtgtaaatgggattacttccatctccatgaatgattacctcctgatggttccattcgaactcacaacctggtgtagcttaaaaaccacagctccagcagcatgtatccaaggtcgtcctagtaaaagattatatgtagcagatatgtccaatacttgaaaaacaacatcaaaccaaattgggcccatctgcaaacaaaggttatattcctcaattgtggccctttaagacccatcaaatgctttcacattcatactccctgctcgtatctcatggaaatctttacccaaccttttcagagtagtcaatggacaaatgttgaggtttgaacccccatccattaggactctggtgatgaatttgtcctcaaactgtagtgtgatatgtagtgctctgttgtgacttagtacttcaggtggtagtccatcttcgtgaatggtgatcttgtggctttccaatacttgccctaccatgttggtaatttctcccctggtgatattgttgggcaggtacacttcattcaacacttgcatcagagcattcctatccacctcaaaattttgtagcagcgacaggatggatatctgggcgggaactttattcagatgatcaataacagagtattctcttgcttgtactttcctccagagatcatttggactagtttcaatgatgggctgtttggcaactgcttccttgctttcccccccccccaaattttcaggtgtatagattcttccagtcctagtcatcccttgtacaacaccagactcttccatttttgctttttcttttctcctagcttcggcaacataatcccaaggtatggcattagaagtgaagggtggtgtggatgctaccgacactgtgaagggtgtggctacttctacctcgaatggagtaggtgtagtcacagttgttgtcactttgatttcaaatggagctgatatgtctacttcaacttcgaccggtggttgtatctgtaccacaatagaagtaagtgtgtctgcaggtttcttagggtcgtcactttcccgaataagcctaattgccccttcaggatcccattcttcatcagtttctatcacatttactccatcacccctatgatttgggagggtattgttgcggacattgggtgcggcttcctttgcttgtatgactttggtatcaatcagggtctgaatcttgtattttagagtgcggcattcatcaattgtattccccttcatgtcggaatggtatgcacatgttttgtttgggttgacctatggagaggagttttccatggcgacacgggaataggggtgtcatatccggcagcttttagtctttcatatagctggtcgatgggctcagtaataggggtgtattgtctaggcggcttgcgatcgaaattgggtctgggtttttttatagttttgaagggttggaggtgaatggtaataggctagctgggttttataagtgtggtaggcagtagcgggttgagaatatttaggaggtgaagggtagtatgtgggtggaggtgtttggtatgtgagtgcatattttggaccttgggataccatcactgcccctacttctttcttctttgatataccccttgattgtaatgctttgttcgtaccctgcaatgcctcaaaattagttaccatcacgctcttgatcccttcttcaatcctttacccgagtttgatgatgtcggagaaattgtgattttcgatgaccattaacctttcatagtattgtggaccttgggccctgacgaagaatttgttcatctgctcttcttctagtgcccgcctgacctttgcagcttctaacctccattgagtagcatattcacggaaagtttccgttggtttcttcttgaggttctgtttgtagaagacgtctggtgcattctttgtattaaacctgaatcagtccatgaagtctgattccatacttacccagctaactcacttattggaattttgactgatgtaccaagataaggcatctccagtgagactcctcatgaacagcttcatgcaaatcctttcatccttcccaaccaccacgagcttgtcatagtatatactcaaatgtaccttcgggtcacccctcccgtcaaacatctcgaacttaggaggtttgtaaccctccagaagttctacttctagctgaatacacggatctttataattcaaaccttcaatacctttgccttcttctacaccctcaactcggcttgtgatcttcttgagctattccgccatattcttaataagcaggtccttctcggcggattctggtatgtatgagattggttgagtagagtggggtaaggtttccacgtatatgggattattttggtaggtgccgggggtttgagtgtagtagtaatcattagatgaattttgcggatcaggaataggttgtggggtattctgagaagtatggtaagtagtttgtgggtattgagtcaggagatgctggtgttgagggggtgtttgtactggtggaggattaggattttggggaggtgttgcgtatttacggggtgcgggtggattttgtggtcattggtgtggtgtattttgaggaggtactgggttctgggcattttgcttgttaataactgggaggtttagggtgagggaaagtcttgccaagttgcggacctgctcaagctccccttacaattctagtatcttttgttccaaccgtaggaccaagtcatgttgtgccggagtactccgaccgtctaaagtttcaacattctccacttgagcaacattttctttccggataccactcatatcatccatctttgcctttcccttgctttttgggttacttggagtaggaggtgatggagggcctctggatctggtgtgatatgttaacgatgccagtatgtgtgaaccaaccttagggtatgagaataatcaaaataaagaaaaaggcaaaaaggtaaacaagtcagtaaggattctgaaaagtatttgcaatatttaaacacgtattgtaggaatgtaaatttgcgtcctaatttagggaaccttgttgtgcccgaggtaggcctagcgacaagtagatttggagaaatttaatgtcgataaaggcctcattttattaatataataaataatacgaacctaaaaacgacaataaataaatgagttacaaatggtgtttgccttattacattcgaattccaaaacaattcaaaaaatagataaacctaatctacttggtcgtagagggaccttcaccatacttgaccctcttggctccgtcgatcatattccccaggtcatgcatgtccagtagcaggtacgcccttgttaggtgtcctctctctttaccctctacattctgacagtctatgacccttttcctcatcttcccttccggttccattagaccctgctccaaatattccaacctttatgtcgaccatgtagccatttccttccactcattaattgactccatgtctaacttatgttgttccaaatgcctggattcgaactcaaggactctttttcgtagcctctcatactttacctgtgcttcagtagcctcatctatgaccctgcttccttgaccaacccctggctcgactattcctgctatgttatcttctaatcatgatgggtacaagtacacatgagatacgggatatcgatctggctctatggtatccttttccacgataatcttcaaatgcacatttgaatggaatggcgtcatcctgaaaatctgctttgtaatgactcattttgaagacttgcggtatgacttgttttctaccagcttgtatcatgaccctgatagtaacatagggatatatgtcccttaacccaatcaacaccagatgcggaacatccctagatctgatgttgaattccctagtagggaacaacttgaacatccaatgaaccttgtcctcgatcaaattgctgaaaaactatacccattatgtagcattctctagttgtggaaacctgtatgggataaaggtcattcttttcgaatgatggaaagctatgtgatcattccatggtctccttggaaacctttggcggtattggcctctctgaagatgttctaacaaccaaatttgcagcagcaagttacaccctcaaaatgtttgaacccttttttgcaacgatccagagcctggtatatttctgctacaatgattgtaacaatagtatttgtttgtctctctattccctccattaaatatttggttaccatgtccaacctggtatgtattctgtccccttggcttgcaaacactatcatacccagaaagcagacgatgaatacaaaaaccttacgatgagtccaacctagagaagtgatggagaattcgttatgaaagatacggtaagattttttgtgtctgtatcgttcatacaggaagtcaaagggtatgtaggacttctttaggcatgccaagtcgtcattctttctcaggcccatcatttttagaaaccccctggtagtgcgattttctggtactagtaaactgagactatccatggtaatccaacgaatcctcctatttcctccaaaagaggagtcatttctatattgccaaaatagaatacagctctttctccatctcaaaacatagtagcagcctcgatcagcatgttgtttggttggatgtccaataaggaggttaagtttccaggaacccttttcgcgtgatttttgtcgcttggcgaaaggttttcctaccaatccagcaataagagtggcatatttcggaccattccaacctggggacttcgtgcctcattttctacaaaaataaatagagttagacccttgccccctccggattctactacatacacattaactattagcgtgttggcatttatctctccaaataattcacatatcgtggttgcacctgttgggattatggaaatcccggtggactttggacaaggtttttcttagagggttattacgcggacaacttattaactcaggataggtttgtgcatgatgcatgtacagttattatcaaagtaaggtttctatagaagtctagactggtaccctcaagcggacagcttgagagggaaaagaacaaaaccgttaatttcaccactgatcgactagttttaccccaaataagcctttccaaatttaaagggtgattttaagaaaagtgtggacactcatcaagtggcactatggtattagtacgcacaagtggaatatgatgttgagcatgctttatgcaaaaattaacacattgtcaagtatttttacatgtttgaaaataaatgcagtattgaatgaaagtaaagacataaaggaaagaaaaaaagggaagaagttagttcgcgaaatcaaggaattataataaagcaagtaaagggggtaaggattcgggagagacatgatatagcaaaattaaaagtttggagcaggtgaacatgattaggaaataaggggaaacacacgttgtaatcgaattaaacgaagagttgcatatgagttcatactggaaaatagggaaaaagatgtgcatgtagcaataaaaggggaaaacaagagcaggatattctaataatagaaaaataacaaaaatacacctatgaagagagactaatttatgcaggtcaagtttgtgatggtaagagcctaaagacaatccccagtagagtctccatgctgtcgcgccccctttttctggaaaaatcggctttcgaccttttgacaactcctttgagagggtagggaaaaggaattagttagagtcgccacctaacggattaaggtgtgttagggcacctagagcagataactcatattataccagtttgcatcactagagatccgataagggctcgaagttaccttgaggggaaggtattaggcacccctcgaggtccacgacggtgggtcccgactgaacttaaattatgtgtatttgtctaaagaagcgcgtaaaactatttaaataaggatgggggttcctgaattttttagcctataggatcaccccgtgcaacataaatagtacttcgtaactcccccaagacaggggtgttactcatattatttgcgggcacagactatcatctccaactacccgattattatctttgagtttttgcttaaagagctctaatcaattctaacttgtatcatatgtgtgtgttacccatcccttacctatggtactgggggcattgggacctctattttggatggttctagactcagcttaggttgctcaaaattgtaaaactaagcgacatacaaaacaaattggacttttcatgcaagagcagataaaggctcagtttatcctccgcacataaggcagcaaatacacgcaaaacatattggcgtattgacagtttaatcaggtaaggatattagatcctatagacatgatttctacatgattctgtatttttaaatatgctagcagtaatttctaaatgatcctataattcactactgatttgaatcggagcaatttgaacctataggcgagttatctaagcattttatgcagtaactaacaatggtgattactggagtatattaagaattggataactgaatcatataggcatgatttctagtgataatggttaacccagcattgatgactattaaagaaacgagtaaagtagttaattaactagttcagatcctataagcatgatttctataatcaaatcgattttagatcctataggcatgatctctaaaattaaactaattttagttcttataggcatggtttctaatattgagcagtacataagcaggaatttatacacattgagcaaaaaacagttaagccaaatattggtcctacaggcatggctgttgatgcataattactggacaaattgatacacctaaaggcaggatttctaacaaatcataacgttggtcttataggcaggatttctatcatgtaaacaaaacatagaacctataggcagtatttctaacatacaacagaatgagccaaacaaacacgtataggcaagatttttacccattctcatgcaaacattaaaactaagccgagttttcccagttcactattgccccaatcgttattacaaataattattacaaaccacaatcgaatgaataaattacaaagtatataaactataagaagcctgcagcaaagcccaaatgtacctggacaaaccaagtcttcaactcgcagcatctccaaagcccatgttcataggtacaacatgaccaatggtgagtgattcacccatgtctcaaagatatgcataaagaacccaaatatctagtgtgtcagagtttccaagggcttcaagaacccggggaagtgctcacactagagaagaatgatcagaatagttcaaggaaaactatggaccaaattctggtgcatcagagttcacgagggtctcataggaaccctgagtagtgctcaaccaggaaaaccaagggacaaggccaagattactttggtttttagccaacagggattagaattcaggatagtgtaaaaaaagattgggaaataggtttaaggagagaatcacacatagaaaagaggcaaacacattgaaactaaacatacatgaaactaaaaagtttgaaacatgctgacaaagaacattttttaaacatgcttcacaaaggcaataaagagttcagattgggagtcatatgaaatcaatcatgaatcaataggcatattggttattaataaacattaataaagaggatgcagcatggtgggcacaggatcaagtgaatacatgacaacagacttagcaataaactgacgagtttacatggtgaatcagtgtcacaaacacaattaataccaaatggcagtcttaagttacacatattcacatgagttcatcaattaattcacgaattttaaacatgtctaaaatacatagagcattgaatctaataaaagtagcatattggacaagtgacacagtagggaggtttcaatgtagtttagatgaaacagaaagaagttaggtaatgcagcaatgatcatcaatagcagtaaacagcaataaggtttctggccttggcttccagtcggccaggaattaaagcagagtagaatatagtatatatcatttcagtagtgagagatactctgattcctaagggaaatgggggagaggtttaaatagcattggactaggcaaataaatatgacaataatcaatcaaggaaacatctaatagtcaattaagggaagaaaactcagaactttatttaaggaaagccagaagtaacaagtgcataaatgcgtaaaatatggagtcagagattttaacacggtaactagggacttaaacagatttgaggaatcaaagactcctaagtttagggtaagtgaaattggtcagcatttatcggcaagaatcacaaaacatatagacaaaatcactgagtgaaataatgaaagaaagaatcgaaaaccctaatttttagagtaagtaaaaattagtcagaaattaatggcaggagttataataaagataaatagagacatatagacggaataattaaagattgaaccaaatttggttcaattttaatgaatcaaaaaccctaattttgggtaagtaaaaataagtcagaaatatctaagaaaaaatcataatagagatgcacatagatagatatacggaaacattatagagaaatatttaacaaaaatagaaaactataacagatcttgaaagatatgaaccctagctttagggtaaatgaagaatcgagaaaatctcagagattcatactataaggagacgaaaaaagaacatagacggaaagaaataaagatctgaactagatttggttcaaaataggagagatctgcttgccatgttaggcaagcaattatgtaacactataaatgggtagccagtagcgagacaagataaataaagtaagaagatcattgatggattccatgtctgggttggaatcaaagggtaaattggtttacggtgctagggctttgagaagggaaaaggaagagatgagagaatacaaaggcggctggtttgggtgaatgagagttagggttaggggtttggttaattaaaatagggagaagggatgttggtcgttaatcttgaaagatcaacggctaggatttaaaggtgaccggggcgggttataatagacgggtaccgaccgggtttagcgggttgggttaattgatttggactgggtattttgggttggtgtataggtgttgggcttgtttattgggtagttttaggttcgaaaataggagtaatttagtgctagttttaaaatacccaatatttaataaataaataatttataaaagtgattaataaatatcaaaaatatcatttgtgcactaaaatgattagattaattacttatcattataaaaatataaaatggtattttatgcataaataatataattatacattcatatgggttgttattgtaaaatgtgcaatttagccttaaaatgtaaatgtaattataaaaatgcactgaaaaatatttaaatattatgatggtataaatgataggtttagatgattaacttatcataaaaatttggagggtaattattggatatttatataataaaatgtataaacaaattgatttagagcttttaaaaattatggaaaattatgaaaaaatacttgtgcatacctgtaaatcaaatgatgatgcatgtgcattattttgaaagtgtatatatatatatatataaatttaaaaaatatgagggaaaaattgggtatcaacaaagtgttgaggtgagttggggaggttgcttatgagcttgctttacctcccagcttatcaggagttcatccagtttttcacgtgtttatgctccggaggtccagtcgtagaagcgacttttggaattttaatgagaaaccacagaaaaggttggttggaccgcaaatgcggtattgcaggtgcagtaaaggggtcgtagatgcgaaaacccctgggcagaatgtatatatgtctctgcttcgcgatttttaaagggtttaaccatttttaacttcggacttagaatttttgggcgattttgaagagatatttcaatggaacttcgataaggtaaggattttggacttcaaacacacttttatggtagtatttcatgaattaggactgaaatttaatcaattaatggactaaaaatggaggtttagggcttgagtttaatagggcttaaattaaggatttgaggggtcaattgaactccgattttggtgtttttgatatgtatgaactcgtggggaaataaggaatctgatgatatgaaaatttatgagtttggagaagtgggctcggggctcgggttttgccaatttcgagatttttgacatttttttattgttttcgcttgtgctttgttcccttaacatattctgatgtatttgttcttgttttggtcaaattcaacgcacgaggaggccgatttgagaggcaaaggcatactgaactcgagttttaggcggttcgaggtgagtaatgattgtaaatgatgtcctgagggtttgaaaccccagattgcacaacgtagtgctatattgaggtgagacatgcgcttaatggtgggcgcggggtcatttacttttggggattgtgacttggtccatcgcgattgatatttttatcacgtatttgactgagacttaattgttatcatcatgacttgggcttattgccatatttgggctttgtgctgactatttgaatccttcatagacttttatcactttttcctcactattttgacatactacttgaactcagtcctattgatttacactgctttacaaactcagccacttttacttgaatttgagacttaaatgatctttcaaatgttatttgggctgagcactactgttttactgattcccaaagggcgtgtgataatttatggactgaatgaggccgaggtccatatgtgaggacatgctgagtgatatgagatactttctatgccatgaggtggcttgagtgatgtgaggccgattgatgtgaggtcgagtgccgagtgatgttgccacgaggtggcttgatatagcgcttgggccgtaaggagcccctctagagtctgcacacccacaatgagcgtgggtacccattatgatctgagagtgagcccgaggggctgatactgttctgagtgattgatactaagcccgaggggctactatactaagagtgagcccgaggggctgatactattcggagcgactgatactgtgcccgaggggtgggtttctacttgttatttacctgttaaattacctgttttacttgtttttaaaaaggaatatcatttgatttctttattgaattactgctttaagtgattttactgattgatatagaattgttttgtgcctttacgtgttttcatactttcagccattatttataattattactcactgagtcggagtactcacattactccttgcaccatgtgtgcagattcagatatcgcagagtccgctcctgagtgctgattctcccagttcaggtagtgattcagagactacgaggtagttgttggcgttcgcaaccccctgcctcccttatcttatcattttcatgtttgtagaactattatatcggatttggtgtttagtagacttgtatccggatttcttagttgctcatgacttgtgacaccccagtttgggctatgttgggatggtttctactgttgttatcattaattctgcaatttatggatattatatcatgctttagaaccatttatgatatttaactgtttaatagaggtgttctgtttggtctggttggccttgtattcatgataggcgccatctcgaccgggatcgggaattgggtcgtgacaagttggtattagagcctaggttacttaggtcacgagtcatgagcaggtttagtagagtatcgtgaatcggtacggagacgtctatatttatcatcgagaggctgcagaacctttaggaaaaacttcatattcttgaaactcttgtcgtgcgaacttatttgtacaacaactaaacttctatattctattctctcgcagatggcgaggactcgtgctaccggacgaggcggaagaccaccagtaccacccactgaggccaccaaagaccgtggacgcggtcgtgatcatggtagaggcagagcagtgagggcagcacctattgatccaccagctgccctagctcaggaccaggctccagctatggatactccagcagcaccagttcaggcaccagctgtgcccatcatgattccgagtcttcaggaggcccttgctcagatcttatcagtttgcactagactggctcaggcaattttagctaccacagcagcatttacttaacaggctgggggatgcaatcagacccctgctgctcgcacacctgagtaggtagtgtagggattgcagatgccgggagcacctccagctcagccagttacaccagttcaggagttcgtagttccagctatgctagacgatgagcagcgtcgtttcgagaggtttggtaggctccagcctccttcattcagtggtgctgagggcgaggatgcccagggttttctcgacaagtgtcagcggatgcttcgtacggcagggattattgagtctagtggtgtggtatttaccacctttcagttctcatgagatgcctttacttggtgggaggattttgagaggcataggcctgtcggtgcagcacttctttcttggcagtagttctccactctattcttagagaagtatgtaccgcagtcccgcagagaggagctgcgtaggcagtttgagtggttgacacaggggaatatgaccgtgacccagtatgagatgaggttttttgagttggctcatcatgccattttgatgattccatcagatcgtgagaggctcaggagatttatggatggccttaactaccatctccgtattctgatgactaaagagagagtattgggtgctacgttcgaggaggttgttgatattgctcgtgagattgagacggttcaccatcgggagcgagaggagagggaggccaagaggcctcgaggatcgggcagttacagtggtgctcctttgaggggccagttcttgtatggtagaggtcattctttcaggccactcaatcgacccgtcccgagtatcgtggggcatcttcaggccatggttatcatagttctcagcagggtcagccttcactcagcgcccttccaactaaaagttcatctcgtgccccgtctgttcagagttattccatgccgagtggatcagctagtcactccagtgcgaggggttcccttcaatcccattctccagcacctaagagttgttttaagtgtggagagtttggacatatgtggaggaagtgtcctcatcgtgctgctagttcatcacagcagaggggtcagccctcgtcttctgctccagttacttcagcacccgcccagccagttaggggtggaggtcaggtaaccaggggtcgccccagaggtggaggttgatcaggcggtggccaggcccatttttatgctaatccaggcaggaccgatgctattgcttccgatgctgtcattacaggaattatttcagtctgccacaaagatgcctctatcttaattgatcccagttccacctattcttatgtgtcatcatattttgctgatcatttgggtatgtcccgagggtgtcttgctttacctgtccacgtatctaccccggtgggtgacactattgttgtagaccatgtgtaccggtcatgtgttgtgactatgaggggtatagagacccgagttgatctattgctattaatcatggtggcctttgatgttatttttggcatggattggttatctctgtgtcatgctattctagactgtcatgccaagacagtcactttggctatgttgggtgtagcgaggatcgagtggtgtggtgtgattgattatgttcctactagagtgatttctttcttgaaggcccagcgtatggttgggaagggttgtctttaatatttggcatttgtgagggatgttggatctgagactcttagtatcgattccgtcccagttgtgagggattttcccgatgtatttcctgcagacctatcgggcatgccaccagatagggatattgattttggtattaacctagtgtcgggcactcagcccatttccattccgccatatcgtatggcaccagcagagttgaaggaattgaaagaacagcttcaggaactcctaaataaggggtttattcggcctagtgtgtcaccttgggtgtatcggttttgtttgtgaagaagaaggatggcacgatgagaatgtgcattgataataggcaattgaacaaagtaacaattaagaacaaatatcctttgcctctcattgatgatttatttgactagcttcaggaagcgagggtgtcctctaagattgatctccgttcgggctattaccagttgaagatcaggaattcagatattcttaagactgctttcaggactagatatggtcactatgagtttcttgtcatgtctttcgggctgaccaatgccccagcaacgttcatgcatttgatgaacattatattttgaccttatctggattcgttcattattgtattcattgatgatattctagtgtactcgcatagtcaggaggagcacgcggagcatttgagagttgtattgcagagattgagggaggagaaactttatgcaaaattctcgaggtgtgagttttggctcagttcagtggctttcttggggcatgtggtgtccagcaagggtattcaggttgatccgaagaagatagaggcagttcagagttggcccagaccgtccttagccatagagattcgtagatttcttgggttggcaggctattatcgccggtttgtttaggaattctcatccattgcatcgcccttgaccaagttgactcagaaggctgctccatttgtatggtcggacgagtgtgaggagagcttttggaagctcaagacagctttgaccacagctccagtattggttttgccattagcttcaggttcatataccatatattgtgatgcttctagagttgggattggttgtgtattgatgcaggagggtagagttatcgcttatgcttctcgttagttaaagccttatgagaagaactaccatgttcatgatttggaattggctgccatagttcatgcattgaagatttgaaggcattacttgtatggcgtatcttgtgaggtattcactaatcatcgcagtcttcagcatttgttcaagcagaaggatcttaatttgaggccgcggagatggctagagttgcttaaggattatgatattactattttgtatcatccgggaaaggccaatttagtggccgatgctttgagtcgaaaggtagtgagtatggggagtttggcgtatattccagttggggagaggccccttgcatttgatgttcaggccttggccaatcggttcatgagattggatatttcggagcctagtcgggtgttagcatgtgtggtttctcggtcttccttatatgatcgcattagatagcgtcagtatgatgatccacatttgcttgtccttaaggacagagttcagcatgatgatgccagagatgtgaccatcggtgatgatggtgtgttgcggatgcagggccagatttgtgtgcccaatgtggatgggcttagagaattgattctagtagaggcccatagctcgcggtattctatcaatctgggtgccgcaaagatgtaccaggatttgaggaagcactattggtggagaagaatgaagaaagatattgtgggatttgtagctcggtgtatcaactgtcagcaggtaaaatatgagcatcagagaccgggtggcttgcttcagcagatggttattcccgagtggaagtgggagagaatcactatggattttgtgagtggtcttcctcggactttgaagaagtttgatgttatttgggtggttgtggatcggctgaccaagtccgcgtacttcattctggtgtgtactacctattcttcggagcagctggcagggatctttatccgggatattgtttgattgcatggtgtgccagtgtctattatttcagatagaggtactcaagttacttctcagttttggaggacttttcagtgagagttgggtactcaggtggagttgagcatagcatttcatccgcagatggacaggcagtccgagcatactattcagatattagaagacatgttgcgtgcttgtattattgattttggaggttcttgggatgagtttttgccgcttgcagagtttgcctacaacaacatctatcagtctagtattcagatggccccgtatgaggcgttatatgggagacgatgtagatcttcagttggttggtttgagaccggcgaggcgaggttattggggacagatttggttaaggattcttagagaaggtgaagatgattcaggatagacttcatacagcgtagttgcgtcagaagagttatgcggaccggaagattcgagatgtatcctacatggttggtgagaaggtcttgctgaaggtttcgcccatgaagggtgttatgagatttggaaagaaagggatgttgagtacgcggttcattgggccttttgaggtacgtaggaggattggggaggtggcttatatgcttgctttgccacccagcttgtcgagtgtgcatccggtatttcatgtttctatgctccggaagtatgttggggacccatctcatgttttggacttcagcacgtttcagttggatgatgatttaacctttgatgtggagccagtagctattttgggtcgtcaagttcgaaagttgagatcacaggatatagcttcagtgaaggtacagtggagaggttggaccgtggaggaggctacctgggagaccgagcgggagatgcggagcagatatcctcacctgtttgaagcttcaattatgtttctttactcgctcgaggacgagcgtttgtttaagttggggaggatgtgacgacccgacccatcgtctcatgagttatcgctctattttttccattttcagcttctttattcttcattatctgtaattggtgtgatcgagtcgatttggattggttttggaaggaaatgagacacttagtctctttaaagaaggcttagtttggaaaagtcaaccggatgttgacttatgacttagagggatcagatgtgatttcctgtgattcggttagcttcgggggatgatttgtgacttaggagcgtgatcggaaggggttttggaggtccggtgtagaattagacttgaattggcgaagttagtattttggcgatttctggttggtaggtgagattttgatccgagagtcagaatggaattctgagagttgcagtagcttcgttatgtcatttgggatgtgtgtgcaaaatttcaggtcatttgggcgtgttttgattgggtttttggtcgaaaatgtatttcggaagattttagaaaattaggcttgaatttgatgtgatttagtagatttggtgttgtttgaggtgttttgatgattggaacaagtttgaataaggtactgggtcatgtttgtctttttggttgaggtcctgggggcctcggggtgatttcggatggttaacgggaagatttgaacttgaattattgcagaaagtgtactacttctgatgttttcgcacctgcggcttggaaaccgcgggtgtagtgccgcacgtacgaggggaaaatccgcagatgcgaagtttgggctagagtgcagtttccgcagaagcggtcgaggtggccgcagatacggaagtccagtcgcagaaacaactttaggaattttaatgagaaaccgcagaatcggttggttggactgcaaatgcggtaccacaggtgtggtaaaggggtcgcagatgcgaaaacccctggggcagaatgtatatatgtctcttcttcgtgatatttaaagggtttaaccatttttaacttcggacttagagtttttgggcgattttgaagaaagatttcaagggaacttcgataaggtaaggattttggacttaaaacacacttctatggtggtatttcatgaattaggactaaaatttaaggaattaatggactaaaaatagaggttttgggtttgagtttaagagggcttaaattaaggatttgaggggtcaattgaactctgattctggtgtttttgatatgtatgaactcgtggagagataaggaatctaattatgtgaaaatttctaagtttcgagaagtaggcccggggctcgggttttgccaatttcgagatttttgacatttttcgattattttcgcttgggctttgtttccttagcatattgtgacgtattcgttctagttttggttcgattcgatgcaaggggagttctatttgagaggcaagggcatagtgagctagagctttagccggttcgaggtgagtaatgattgtaaatgatgtcctgagggtttgaaatcccggattgcacaatgtagtgctatattgaggtgagacatgtgcttaatggcgggcgcgaggtcgtttactattgggaattgtgagttggtccatctcggttgatgtttttaccacttatttggctgagacttaattgttatcatcatatcttgggcttatttccatatttgggctttgtgccgactatttgaatccttcgtggacttttatcactgtttcctcattattttgacatactactcgaactcagccctattgatttacactactttacaaactcaaccacttttacttgaatttgagacttaaatgatctttcaaatgttgtttgggctgagcactactgttttactgatgcccaaggggcttgtgatgatttatggactgagtgaggccgaggcccatatgtgaggacatgctgagtgatatgagatactttctatgccacgaggtggcttgaatgatgtgaggccgtgtgatgtgaggccgagtgccgagcgatgttgccacgaggtggcttgatatagcgtttgtgccgtaaggggcccctccggagtttgcacacctacagtgagcgcgggtacccataatgatctgagagtgagcccgaggggctgatactgttctgagtgattgatgctgagcccgatgggctgatactgtactgagagtgagcccgaggggctgatactgttctgagcgattgatactgtgcccgaggggcagatttctacttgttatttacctgttaaattacctgttttacttgtttttaaaaaggaatatcatttgatttcttcactgaattactactttaagtgattttactgcttgatatagaattgatttgtgcctttgcgtgttttcatactttcggccattatttttaattattactcactgagtcggagtactcaaattactccttgcaccatgtgtgcaaattcagacatcgtagagtccactcctgagtgctaattctcccagttcaggcagtgattcggagactacgaggtagttgttggcgttcgcagccccgtgcctcccttatcttatcattttcatgtttgtagaactattgtatcatatttagtgttcagtagacttgtatccggatttcttagtttctcatgacttgtgacacaccggtttgggctgtgtcgggatggtttctactattgttatcgttaattctgcaatttatggatattatatcatgctttagaactatttatgatatttaactatttaaaagaggtgttttgtttggtttggctggccttgtcttcatgagaggcgccatcacgaccaggatcgggaattgggtcgtgacactgggagtccaagaagtacatgcgaagcagatacccacacttattcagcacttcaggtatgaatctaaacttgttcgaggacgaacgtttgtttaagaggtagagaatgtaacgactcgaacgatcgtttttcttgttagaaacgtgttcccttaaatgagacttcccgtactttcttttactaatttacgacttgtgagaattcaagattttgaagagtttgggttgaaatcgaaacacttagtaccttaaggttggctttaaaggccaagtttcacttcactcaacattttgaccaaacgatctcgaaatcaggatttcacggttccaataggtttgtatgatgatttcggactagggcgtatgttcgtatcgggttttgggtgactcaggagcgtttcggcacctaatagtgaaagttggttcttgaagatttttgaagttctttaaatttggatttgaagagattttggtgatattgaggtccaagtggaatttcgaaaattggaatagttccgtaatgtcatttaacacttgcatgtaaaatttggtgtcaatctgagtagtctatgtatgattggacgcgatcggagccttgaagttcaaagtttgattcagtttgggtttggggtgtgattattggttttgttgtattttatgcattttgacaattcgagcaagttcgtattatatttttagaattgttggagtagttggaccgggtcccgaggggctcgggtgcatttcggaccgcccggagttgagttaaacacaccagatttctgcttctcatttccttcttcgtgaacacggtcatactctcgcattcgcgataaaggatttggggtgctgtgggctgggaagctttttcccttcgcgttcgcatgcctaggatcgcgttcgtggaggcttgggtcatctagccatcacattcgcgtgacctggctcgcgttcgcgtagaagaggctgagctgggtggtcgttgtttattcttcgcattcacgtagggtaagccaagcaagccttcacgttcgcgaggctcttgtcacgttcgcgatgggtaatttacctgggcctagaccgtttgacttcgcaatcgcaaggcctctatcgcgtagaaggaagacctgggcaaaacacttttcaaaaatgggacttagctaggttatgttggctcatttcttccgttattgagcgatttaaggagctcttagagaggggatttgacttagcactttgagataagtaatttctacacaatgtgagttaaatacatagtttatgggtagattataacatgtaaattggtgaaaatcacgggtttaggtggaaaaaatgagatttaaccacgatatttattattgaatttagtaaaaatcatatatttatgttccttaggttattggtaacaactttctttaaaaatttccggaatccaagcatgtgggttcgggggtaaattttaggaatcttgcaaattaggttgggtaatcacttaaatggtggaattatgaacttttgagcatggatgattagtttatgtactgtttgactagcttcgagttgttgggcatcatatttggaggtttgagcgcgttcttgaattttggaagtaggctttgatacgaggtaagtctcctttttaaccttgcaagagggaattaaccccacaggtgaattaaatacatgtttgaacatattgtgggggctacgtatttacgaggtgacgagagtccgtatgcagctactagtatgctattgtccgggtagtttaggacccgtatcatgctataattgaaatgttgtgcccttacttactaaaataatcacttaaatgatgttagaaatttataaaggaattgtatgaggttaaactcactaatttgaaagtttgcatgaaatacttgactataaataggaaatttgtgttttcttgaaaataaattgttatttatggatcgggccgagcgcctcggtagtaaatagatgcatatatggttctcaccgttcgaccctccagtagtgcacattttaatactatattggatcgggttgtacgacctcgacataattgtgcatgttaattatttggaactctccataatttttactgcttaaatgctttgaaatgtaagttgttacatgatatgactgaaattgacatgttatttatgaaagaatatcttatatcttcctattattgaacttttagtattattcatgatatctatgcctagcataacactttaattatatgattgttggcccaagtaagtgtcaagtcaacccctcgtcactacttcttcgaggttagactggatacttactaggtacattttgtttatgtactcataccttgcttctgtacttaattgtacaggatttgaggcaggtgcatctagttatccgccaggcgtgcattcttgatcttgggctgagacttcacggtgagctgccccctttctagccgttcagtagcatgccagagtttctcttttgcttgtacctgtctattctatttcacaataggatagtcattttttgtatattccattagttgcccacacacttgtgacactagatcttggcacatattagtagacttgatttttggttgtattcctataattatgatttcttttagttgtttccgttttggttgccttaaaaatccaatacatatatatatatatatatatatatatatatatatatatatatttaaatttaaataaagttagatgttgggattgcttaataaaaatgggaaaccactaagttattcactgttggcttgtctagcaatggtattggacgctatcacgacctgacatggagttgggtcatgacataagtgaaggataccttatttagacttgtattttaaagtacaagagggggtgaattataaatatttaaacctaatcacttattagttgactagataatcgagtagtcgactggatataataacctaatagttataatgatagaaagtaagatcagaaagtaaatgcaggaattaaagacaccaagattttatactgatttggattcaatgtgaatcctagtccagtccccttgggttgcaagagagttctctttagtaatgtgtttctccaagtacagttgaaatgaattgacaaaacggtttctctagcactcgtttctttttgatacaatgtctcaccggtgttatactctctttttttctctgaattattacacaacagatcttagtgaactacaatgtttgtttgcagtagaacaaagagaggtatttttggtttgatcaaagtatatatgacgaaggtttaaggctgggtataaatactttgatgaaggtcgaggcttgacaacccaaaagattttatccttagaaagatattgattctttccaagaataagatagctagatgttacttttccttttccttctttcagcagatgtatgtaatgaacacttgctccttgattgttggttcttctgaaattagttgcgtatcaatctttacaggatcttcgatcttcctagatgctggccttgattcatgccttaagtttaggcttgcttgattctctccatcgcagctagccgttactctttgctgattgatttgctgattgagttctttccttagttatccagatttgcgagttctttccttgggcatccagatttgctgattggattgtaatctttgctgattgatttctttccttaggcatcaaaattgactccagcgatcttgtagtatcttcttgattccttgtaattgatttcctgcatatgtatattatttgcatcattaaaactggatctaacaatctcccccttttttatgatgacaaaataatatacaaatgtaaacaccagttgacttccctatgttttactcaccctcaatgtatgcagttgactagtccatgatactccccctcaatgtatgcagttgactagtctatggttgagtcgactcctgccacaaactgaacctgtacagatataacatatactctttctccccctttttgccatcagcaaagagggaacaagctaagaactaaacagaatatatagcaattaaacatgagagttataggaatcatccaatggctgagaaaacagcccacaaaaatagcacagcaaaaaataaattatccaaaggctgaaaacacagcccaaaaccagcagagcaaaagaaatatttttaaaacaaccacagtaacggtgcagaaaataagtaagggtgttgcagatgacctccttcaattgttcaaagcttgcattggctgagatgctcactccatccaacctgtcatgaatctccctgaaggctttgacagccttctccctaactctgaaaacagcaactctaattttggacacatcagaccctatttccttggaaatggcatgaatgtcacgaacagtagattgagtggctttgagaagattttttattttagagagttgagagtcaatagcatgaagcttttcaccaagatcagggctgtcaagactaggatgagggacaacgggtgaaggtttaggctctacaggtgcatgctttgcttcactatcgtgcttcttaacctaataacactttaaactcacatatcccatactagcaaaggctctaaaattgtaagacttagaggtagtgatgaagggatagttggacagggaaatttgataagcttccagaatgtgagtgatttccatgccatagggtagactggtgggatcttcagcactctcgatcatgaaattgataacccaggaggaaatattgattttgagtttggtcacgaggcaatagatgaagaaagtgcctctttgagataaggttgaaaaggaaccagtacggggaagtaaagtagttgctacaatgtaggccagaatccgagtttcgaaactgacattactgggacctaactggtttggtagggagtcagagggacagtcagcaatacactatttggcttggtcaaaggaaatttcaaagtcatcaggccaggtatttttaaacaacataggaaaaccagaacaacgacactgaaagagcgaatcaaatagggcacactgaaaaaggttctccgccttaagaagagggtgtctgacggttgagtacagaaaaggaaaaattgtcagttgaagagacgtgatgattggcttttcaactttgcacgacgaactaatgtaaaagaagagaaaagagagggaaaatggaggcgtaataaatgcatgggtaaaggacaatcattgcaaaaaaaaaattaacaatacacataggtcttaaaagttattagtaatgcaagtaataccaagtaattttcttaaatcacaaaatctctcttctaatgaaggtttagtaaaaatatcagctaactgatcagtggttccaacaaaagatatttctatgtctctcttaagaacatgatctctaataaaatgatgcttgatatctatatgctttgctctagagtggtgcacagaatttttggaaagacaaatagcactagattgtcacaaaaaagtttgtataggcttaaaagaaagttcatagtcacccagttgatgagacatctacagtagttgtgcgcagcattgtccagcagcattgtatccagcttcagtagcagacaatgcgactgatccttgttttttactgttccaggatatcaatgcctttcccagtaattgacatgtaccacttgtgctttttctatcgtccttatcacctgcaaggttagcatttgaaaaaccttctaatttaaaagagtttgagcgaagataccatagtccatgagatacagtcccaataagatatcgaatgattcttttcacggcggtcaaatgtgattccttaggagctgactgaaacctggcaaatttacatacactgaacataatattcggtcgatttgttgttagatacagcggtgatccaatcattccacgacatttagttttatcaacaggaatgccatgttcgtctttgtctagatttgtggaagggctcattggtgtgccaatggattttgcattactcataccaaatttttaaatcagctttttgtgtatttggtctaacatataaaggttccttcttcagattgttgaatttgtagtccaaggaagaacgttagctcacccatcatgctcatttcgaattctctttgcataatatttgaaaattccttgcacatgagagggttagcactaccaaatataatatcatcaacataaatttaaataataaggttacctcccgatgatcttttaatgaacaaggtagtatctattttacctcttgtgaagccatgatcaacaaggaaggaactcagtctatcataccaagcacgtggagcttgttttagcccatatagtgccttagtgagcttgtatacatggtataagaattttgaatctacaaatcctgaaggttgtttcacatatacttattctttgataaatccattcaaaaaggcacttttaacatccatttgaaacagcatgaatcctttaaatgatgtgtatgccagaagaattcgtatggattcgaaacgagctactggggcgaaagtttcatcatactcgtctccttcctgttgtaagtagccctgagcaactagtctggatttatttcttacggcctttccatcctggttcaatttatttctaaaaacccactttgttccgattacagacacattttcaggtttgggtatcagattccacatttaattcttactgaactgatctaactcttcctacataacttgtacccagcttgaatctttcagtgcttcttctatcttttttggctcattctgagagattaatgcaatatttgctttctttctgagggctcccctagttttcattccttcatttggatcccctataatgaattctgaggatattcaggtttgcttctccattcatttgggtgaactacattcgtagttgactcgattctttaatctagtacattgctgctattttcactagttgactctgtcgcagtagatatatcaatcgactcttgagatttgttggtctcctaagtttcttgagcttgatcttcatcacctacaataattcatttctcgaccaagggattattttcatcgaatataacatgtacagattcttgcacatataatgtgcatttattatagactctaaaagatctactatttaatgagtggcccagaaaaatatcttcatcacttcttggatcgaattttccaagattatccttaccgttattatggataaaatatttacttccgaagggagggaagtaactaatattgggacgtttacctttccataattcatatagagtcttcttcagaataggcatatgaggcaacggttgagaatgtgacatgttgtacttacaccttctgcccagaagtggtttggcagagaatgttctagtaacatggttcttgccatatcttggaggattctgttctttctttctacaacccaattttgttgtggtgagcgtggtgcagagaaattatgggtgtatccctgatcattacaaaatcttcaaatgctctactttcaaattctcctccatggtcattatgaattgttgaaatcagatgtcccttttctctttcaacctttttgcagaaaatttcaaaatttcttaatgtttcatccttatgagataagaaaattacccaagtgaaacgtgaataatcatcaacaataagaaaagcatacctctttcctcctatactagcagttctagtaggcccaagtaaatccatatgaagtaattgcaaatgttttgaagtagatactatatctttgtttttgaaagagtttctggtctacttacccatatgacatgcatcacaactatgagttctagaaaattcagtttgggtagaccaacaactaactcatgtttggacaatttttctatcaaatgcatgctagcatgaccaagtttcctatgccacaaccatggatcatcagacatagaggataagcaaatatgtccatctattttttcaaaactatcaaggatataaacatttccatacctttttctaggaaggactattttacctgattcatcttcaatagcacatcctgttttcttaaaatttacctcctatcctgagtcccagagttgacttatgctcaagagattgtagttgaggctatcttataactctatcatgtttgagtttccagtctttaacttccttattgagtctcttaaactcattcatcatttttttgagactctttcaaagttaaatcaataatatcctgcaattcattgcatctttcacagttataagatcttacctcactggtttcacctcgtgctatgaaacagttttcattttcttcatgtgaagtgcccttatctgtccagcatcctgaggatttgttcatttcattttcaagaattgtcatgaagcggagatttgctatctcttcgtggtctgaattatcctcatcgctccagcttccaaaggatttgttcttgttgaagcctctagagatctccctttttagttctgggtactcagcttgaatatgtccaaatcttccacattcactttctatcattcttatcattttcgttgtattgcctggatcgtcttggtggaattcttcctttctttgtgttcatgtatcttctcatcaatccatcaatgtttcttgatagcatagcaatctcttcgtgcaaagcttcaggatcatcatcaatttcgtatttagctatttcagtagaggttttgaatgtgactattttcttttttcttcttgactggtcttcttgagatgcgtcttttcaaaagctaggagttctcctcgtagtttatcataggataatttgtgcaaatcttaagattccagtgtgacaactttggtctgccaagtggttggcaaactcctgagaatttttctaacttgatcaccactggtgtaaggcttgccaaatgcctttagatcgttaattattttgctaaacatggcaaacatctcttcaatagattctccttctttattgaaaagagttcgtaatcatggaccagcatgtttatatgtgtttcctttacattgttggttccttcataagtgacctcaagcttgtcccacatttctttatctgtgtcacagcttgagattttctcatattctttaccacttatagcgttatgaaacagatttctcgctttgttgttaacttgtaccatttacatatgctcttttgtatatgaatctatatcttcaggatcagcaagtggtggagtggcagctggtaagggatagtttccttttttgatgactctccaaactttgatgtcataagttttggcaaagatctccattcgcactttccaatgggagaaatgttgcccattaaagtatgatggtctaacttgtgaaattccttccagaaagagagctcctatgataacttgatttgccatgatcttttcttacaagctgttaagcaaaagtagaatgtgagcattgctctgataccaattaaaactacacgagggggagtgaattgtaaatatttaaacttaatctcttattagttgactagttaatcgagtagtcgacttgatataataaactaacagttataatgacagaaagtaagatgcagaaagtaaatgcaggaattaaagacaccaggattttatactggttcggattcaatgtgaatcctagtccagtccccttgcgttgcaagggagttctctttagtaatgtgtttctctgagtacagttgaaattaattgacaacacggtttctttagcactcatttctttttgatacaatgtctcaccagtgttatactctgttttttttctctaacttgttatacatcagatcttagtgaactacaatgtttgtttgcagcagaacaaagagagggatttttggttcgatcaaagtatatgtgactaaggtttaaggctgggtataaattttttgatgaaggtcgaggcttgacaacccaagagatttgatctttggaaagagattgattctttccaagaataagatagctagtcgttgcttttcattgatttccttctttcagcagacgtatgtaataaagactcgctccttgattgttggttcttttgaaattagttgcgtaacaatctttacaggatcttcgatcttcctggatgctggccttgattcatgacttaagtttaggcttgcttgattctctccatcgcagctggccgttactttttgctgattgatttgctgattgagttctttccttagttatccagatttgcgagttctttccttaggcatccagatttgctgattgaaatgtaacctttgctgattgatttctttccttaggcatcaagattgactccagcgatcttgtgatatcttcttgattccttgtaattgatttcctgcatatgtatattatttgcatcattaaaactggatctaacagtattagggttaaaactcatctactatataaagtgggggacgtttttattttttgggttactgttggcatgcatatcaaagtactaaagcttattctggcttatggcaaattgtctaagtattcttcaatcgctcattgacttagccgtatccgaactccatctcgagagctcggttgtggtcgattgttagtatttaagcttaatacggggcctaattacttttacatattggtttcatcgttttattctcacttcaattccattatataccgttctttaatcattttttgttaaattaaaccacttaacctttaaaccgcatataaatttaattgttatccgttttaagggtaaagagaaaaattaaaaataaaaaaatttggccattgaacttagggaaaggccaattgatgcacactcgtataatatttttgtactcattctatattggaattctccatcaatcatagggtgatataaattattaaacaagttttaaaattcagaaaaagctattggtacacccataattaggccaatccagcttgttctttaacaaactatttgcaggtgtattatcactaacacaacctgcaacacttcgataatttaatttattacctcaaccaaccgaaattagaatataaaatgctttcggatatttggtagctcatgttgtcaccaacagaatacaaacttgtttatcaaataaaatctttcctttatatatgtgcaaagattatattccagtgatcttaaataaataatctgaagttttttgaaatgaacgtgatctcgtcatacatgatatactatattaatatagttgtttactcacttttcaagaaggaaatataatattcattacatagtaatagattatcagttcacattatttatttctcttgaaattttacaataatgaatgtaaaaaagcacaatatgtgggtgcttgaaatgtaatcttcgtggaagttcctaccaacatatcaagaaaaaaaaacctgaaaatgtataagtagcagtagggtttcaaatattccattaatttagtaagtgaaagtgcaacaaattaaactagtcatccaaaacttataggggaaagaaaatgaatccagctgatgaaaccatatctttctctgaccttggtttccttgaatctatcaagcagcaccttttgattgattcaaatttttctgagaatttttcaaatgatgcattatttaatagccctagcccaagttcagctgaaaacagctttaacacctccctttgtgatgaaaactgtgaaaagtccgagttccaggaggaaagaaaggggcctaggtggcgcgtgaggaaaacgcgccgcaagattggaggcgctacataggagtgaggcggcggctatgggggacgtttgcggcagagatataagagatccgaataggagaggcgcgagactgtggctaggaacttatgagactccggaggatgcagcattagcttatgaccaagccgcttttgagatccgcggctcgaaagcacggctcaattttccgcacttaattggctcgaacatgactaagccggctagggttacagcgaggtttcgtatgcgctcaccggagccatcgtcttcagcttcttcagaaaatacgacaaggaaaatgaagatagatgtgataaactccatagctaaagtaaaatttattcgtcatagcttgattaatctacaaatgttggtataattgtgaggaagtaaggtttcttcgtgtttaacaattgcaatataaattatggaggcggtttcaggattttaattttatgggttcaaatttctaattctaccgctttcatctaattaactaggttcaaagtctattatttttgcacatttagtgaatcttttaaaacatatacatagtctatgccaaaatttagggaggttcaaaaccaaaccttaaccaaaaattgaaccacaaaattggcttaatgtcttatttgtatcgggttatcatattaactgttggtgagtggattgaaattttataattaacgatttattggttttgaggcgaattattcaattttcttaacggataaaccgttaacccgttaagaatttttatatttgtattttttacccttatgtatattaaatatccttccactatttaacaaacactacaagaaatatgtgatacggcgacatttaattagtgacaattaagataaatgtccgaaaaaagttaatttagtgacatttgttagaaaatgtgataagaataccgacatttgttgaaaacatgtcaaaaatattttgacatttgatttaaatgtcatattattaggaatataacaacatttaattagtaacatttataacaaatgttaaaaataattttttcgcccaacaagaaaaaataactttaagcactttatgggcctttaaacttctcttctttttacagaaatacaagaaagttaaaaataacattcaacccgattcctccacaactcttcaagccgcaaccatctccgtatctttcactcattttgatccaaatccgccggtaagatttttcttcatataagtgctataaatcacaatcttctgtattatatttcttgtctgcttttgactgtttgttgatagccctaaatttgccgtctatagtcttgagatttcttttgattgaaccttttgattcgtttcagacctagaagggccgcctgccagaattaaatttcagcaattatcgctctcagaatctggagttgcaatcagattcatccactctaactcgtgttctgtacgtttggacttttctttttgagtgaaatgagatttgtgatattttggtttctgaaattcttgaacttttttctttcttgttgtttatttttgttttctttttgaaggtgaatttcctgcaaaagagtctagtaacgttgatattactccatatgaggttaaaatgtaattttgctacttaccttttcccttaatcactttggtgataattttttttaaaaaaattcagatcttggatacatcagattttgaaggttgtgagatcaattaatgtgaaggaatcctgatttggtgaaagtatatggaacacttcatcaagaaaaatacatggatgctgaagctttgaattatgttggtgtatttgaaaattataagagaaaagttatggttatgtggtcatgtgttgaagtcattcattacgttgtttgaatcgtatatggtgtacaactcttgaaacttttgaaaggaataaaaatatttgtagtattgtaggatcagcaatagttgattcattgttttctacattcttaccacatattctacataatacttaaaggaacaaaaagagaatatttttctttttaatcataatataaataatgattttgatattcaaataatatgtcaaaaattgtaaacgatttatctgacatttctatgtatgtcgcaaacaagatagtttaagagctcaaattgttgacatttgataaacatcaaataaatgtcactagatttttaccgacactaatttaaatgtcgtaaaattaacgatatttaagtttccgatatttgaaataagtgtaaaataaaggtcggtaaatgaatttacgacatctaattgacttatgacgacatttatataatgtcgccgtatcccatgtttcttgcagtgaaagtagcagttatgattcgagttcagaaggtttactaagacactaactgttattgttttatcttagatactaacttagtgctattagattattgaaaattcactctcaaattctagtgacttctgtcggttagtgaaaatgcacttgcatgtgactatatggtttgatgcaatagcagaaaggaaagagccatactcaacactgatttagtatatggctattacataaattttcagttagtgattaatggtttgaatattcgggcatgacagtgtcatataaacaggttgaattcaacatttaaatttagtgatttaatgttaagtggtatatgcactcatgtctatttgatttagccgataaatcgctcgataatcgctaaactgatattaatccgcccgatatcttatcgatttggctagcgaattagtacatttacgagccgataaccgataagtcgaaccgttaagtataataatatgtctgaccagcacgataagcagccctaccaaaatctaatgaacccatagattatacattggataccaggcaatattctcatgaaagaaaaagaagaagaaaaaaaaagctgctggacgacgacttgtaaatgtactttctcttacgtgacctttcttttaacgagattaattagttgacagataaatcacttccataaatgtcgtttgttcttctgcttcccttgttcatataaagccttaacacttggaggggaaagatgaatgttttgtattagaaaagcattgatcattgtgctggtgtttagtttggtaaaaaaaaaaaacatgtaacaaatgataatcttacaaggagtagtatatggtataaggatcgtgcttcaataatattttgaatattaaagatcgagaagaatgtatagatgttgattgagctaagtgaaatgaattttttttattttaaaaatgaaaatagagggaaaatttccacacccatcaatgatgatccctttaggtgaaacaattaaaaaagatttcatcaacaacaacattttataaaatatttactcttatcaaacacaaataagtccctccgtcctattttgtaggcatattcccttactagttcgttcctaaaaaattaatatattatcttaatgataaattttatagttaatcacacaaatattgctgtgtcatgtttaagccaaaaagtttgtcttatatcaacaagtaatactctgacatgtttataattacaagttttaaaaaaaaattatttttaaatttcatgtgaggtctaacaatgcaaaacaaattataatagagggaatatattatttctcatttactatattttttttttcctccctcttcatatccatcgagagcttcccacatgctagacaccaaaaatctataagattctttccacattgtcataaagaaaatcattaatttaatttgttgatgtcacacctccttttttcgcccccgcgagagacgtaggagttttttccaattaaaggacaatcgaaacgggatttgtttatttatttcagagtcgccacttgggagatttagggtgtcccaagtcaccaattttaatcccgaatcaaggaaaagaatgactccatattacagtctgcgtaccagaaatctggataaggaattctgttaacccgggagaaggtgttaggcattcccgagttccgtggttctagcacggtcgctcaactgtcatatttggcttgattatctgatttaatacatgttgaacctatgtgcaaaatttaacttttaaccgcttttatcatttactgttatttttatcaaggaattgcaacgttttgaaaatgtatctcaaaccgcgtcacaatcaatgtactcgtggtcgttgacacactttgactccgttgagatttggatttgggtcacataaatgtgcacccgagtttaagaaggtaagatttattaaggcgcgccctaaagagactaacgtattgttatattaggaagaggccgtgaaggttcattaaacggccaaatccaaagtctagtcaatggttatgtatttattgagggccccagcgatgtgtgatttatttggcgaggctcgtctcatttttattttttaaggataaacctacagtgactacatttcttctattaagtttgtctctaaaataaaagaaaatccctcaattaattacgagtttttattttatttatttaagaaagcatgacatactagttgctagattaatacaaatattgatgaaaaggaattttactcaaaaaattcgaaattataaataaaataaaaattcgacaactaatattcaaaagaatcaaatacagctagattaaaactcagcattgttataaaaaaaactattgagattaattattcacaaccatttgaaactagatttaaccataattactaaagcttattagaaagtttattagacttaaacattcttctaatcttgcctggactcaaatcatgccttaatgcctaatttacgaaatttaatttaaattcatgccttagctaaatttagctacttgttcatgattaacctactgttgataatcttgaaaccttcataactagtgaattaacccattttgccaaaccgattcattaaagactaacttatgttattttttcttattccaattattatttagtaatacatgaaatagcttaaatacaatcaataaaaggaacaaaaaaatgaatttaaaacttcaaaatttcattcttcatatgtattcatgcttctacattattagcttgcaatagctagtattacagtcgtgtacctggtattggaaacaaaagaagatgaagatgagaatcagcagcagtaataacaatacagcacagcaacaacaacccagcaacagtaacaacccaggaacagagtttgcaaaccggtggagtagtaatccaaaaaaaaaagcttcaagcttcggtgaaacaacaacaattaatgttgatttcaaacaatggaagaaagtagaagattttttttccagtttttgttctctcctttagttttgaaatttctccaatttttatctcttctgtattctgtcccctcttcttgtgtattctctgttctctcttttctttttctgttttcccgataatcttcttttctttttcccccactctatgtatatataataaccaaacagatccgccctcctttgaaaaatttcacttacccgaccaaaatctcaaaaaatctgcccattttcaacaaaatcctactaaggaatgtttttccttattttattccctaaattaaggcatgatataagggtctgtcctccactaacattaaactaatatataagcttttgtcttattagtgcttgacttacggaccattaatttagtcaattctgcccattttccattcccaaaataccccttttaatcccactacctaatgttttgtcccccattatattaaataaatgtatcaatcccaacccattacctcttgtcccccatgcctaacataaacaattatatcacccacgccccattacattttgtcccccatgcttaacataaagaattattcaaaatgttcaattaccaaactacccctccaaccttattgcaattaccatctaccccatcagctataaccaattcacctaatcaatctcaaccaaaatataaccaatatgaccaatttctaaacaaattcaacaacaaatcatatgaacatagatgaatcatttaacttccaattaatggaaataaattaaccatattggtaaccaatcctggttaacttagaccaaaaatggatgagcaaggaaacaacaatattaacaacacacacatgattcaaactaaatcaacaaatcaaaaaccaaaacaaactcaaattaaattactggatgaacttcaaacaaagaataagcatgcattaaatccatattaaataacaaacatgacggattcaaatgattaaaccaacatatttccctattacaactaaattcttttagaaaaataaaaacaaaaccgaagaagaaacaattatgaaattaaacttgaatctaacaacattaacaatttctgaaaaatacataaaacacatgaaacaaattgaaaaaataattaattaaatttcaatttgaatctaataaacattaaactaacaattcctttttacaaaaataaataaaattaacatgaaataaacatgaaaaacaattaattaaatttccatttgaatctgaaaattaaatcaacaaaacacatgaacaaactaaaaaattaattcaacgataaacatgaacaaaacaagaatcaaacatttatcgattttagatccgagaatatcaaaacaaaaatacgggcaaaatgaaactcaaacctactaaccggatcgaagcgacgatgaagaagaacggaaacagaaaactcgaatcaagactcccaacctcccaacggatcccaaattcaaagaaaatccaccttctcttttagacttgacgaacttcaactggacctcactaaacgacgaacaacaacggactcaaacaaaccaatcgaaaccttgacagaacttcgtcggattttaaccggactgctttgcttttcctccgtgtgcgtgcgatggggagcagcagctatggtgagcagcagcagcacttagctgcgactgaagctgcaccaaactttaaccgaagcagcagcagctatagtgagctgcatgaagctgcgactggagaggaagaagcagcagcgatggtggacgcaatggttattgttgagctggagcttgacgaactgagctcgagctggggttgtcgctgcttgctcgttcatggctgctcggagatggagatgctgatcgtttggacgcgaggcgttggcttctgccgggtagtttctcgaaccaactgctcgaccatgctggatgcagcaggagcagcagaagccgcttggctttggagcaaaggcgacgaagcagtggtcgttcatgttattgggtttggatggagaagatgaagcagcaggggcagcggtaggactggttgtcgtttgcgacgtgaggttgagggcagccatggacgagcctgagctcgccatggagaagatgaagacgcagcagtggcagcggctggatgcgaggaggaggaaggaggggtcgttcatggcttgggttgtcgaagctagagcttggaggggttgtttggttttaatggcggactgggggtcgacttgggtgtgaaggagaagacgatggaggctcgggcagccattggagaggcttagagttttggatatggtgaagaagaagagaggggatgggggcggatagtctaggttttttagggtttgggttttgttttgttttatgttggaaaaaatgaaaaatgaagaggggttgggtattggggttatggggcggaccgggtcgacccgtatggagatggaccgggttatggggaaggttgggcaattatttgggcttgtggtttgaaatttgaagaagaggcccaattccgattttctttatatctttgctctcttttctttttttatttttctaaaactaaattataaaaatacttaaattattattaagaactaaattaagttataaaagcgcaaattaactcccaataacaattaacgcgcaattaagtaataattaagcataaaattgtatatttggacattaaatggtaaaaatgcaaaagatgcctatttttgtaatttttattttttgtaaaacaaacttaattactaacaattgtagaattaaatcctacaagcaaaatgcgacatatatttgtattttttattaatttagcaaataaacatgcacaaacaaatacaaataattatccaaaaatgtcacaaaaattcccaaaattgcacaccaaggaaaatcattttattttgaattttttgggagtaattctttcatagggcaaaaatcacgtgcttacagttgatatttcatttcccaaaaaacatagaaagagaagaatccaaagtaaaaatgtagtagagcaatatttacctttgtttacccttaaaataaataacacaattaaatatattgtgatttaaaggatatgtgatttaatttaacaggaatgaactaagagcaacaaataataaaattaaaagaaaacaatgcgatcaaacctaatgtgatgaaacaattaagctggttttaagtttggatgctgaaaccagtctcgaatgagtcctctagatgggctcacttgaaactaaagaaatgaataactgaagaacactttgaacaataactagataagaacctttcaatctcgtacaagtctaaataaggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagatccaagaacctgaaaccctaaaaattttccaatcttggaatttttccgattcgagtgaaggattgaggtccaagatactttaatcgaggtattctcaactgagacttcgaataaagtctgttcagcctcaaaaatgtctgaattcaagttgagtctgtgtctgaataaatttgaagattcagaggtattttttctatttcttttgtgtattctacgtgtattttatgtttgtttcattagtctgtgtaattttcccatcttttattgttatactgtctcatactcgtctatatgatcaaaatatgaaactgtttctgttggttgtgattatttacaatgtgagtaatcgactcgattaagttcgtcgattagttatattatgaattctcatttatgataatactgattgaaacaatctgtttctatttttatggactgtttgttgacagatgttatagataatcatttttaattaatactcgtcagttaaatcatcctagtttatatgaatctgtcaaaataagtactgtatatatgttattgtctgaacattaagtttcagattgccaatgctcctgtgtttgtttgattttagttcaaagttgaagttcagtataatttgttatgttgaaattcagtataatgttgttgagatgttaggtaaattcaatttcacaattgttgggtagatacaactgtgttaggaacttaagagaattggtattagctgttttaaatcaggttgataattaggtttgaatagatttttaaatctgtttcataatagattctgatcttgtattaatgggtagtaataacagtaggatttcagggcatttctgggaatgaaacagtaaaaaatagtattagtgctagtgtgctggaagtggagtgttaggggctgttaatctaataggataataggaaaccaaaggaagtggaggggctgaaaataaagtaaaggtatccttagtgctgtttgaataagaaaaagcagttcagtggcagattttaagggaaaatctgccttagataacaaaaagggggtccaggcagcacttaaaaagaaagggacagacctgtataaatacaggaagcaaacagatttttaagatcagattttagagagagagtttgaaaagaaagacaagttgagatctaatttttgaaggcattagagagaaatctgaaaatagagagagatacattgagaaaaatcagaaatagaaatttgaaaaaagaggaagagaacagaaaagaaacagaaaaaatgagaatacacacctatacgcacaatctgaaacagatatagaaacagaaaagaaaatcagaaacatacttttctttggatctgtccgggtctgtttgtttgatattacttggattaaatctgaaagttttcccaaaaatcctgttactgtgcatctgggctcctcggatcctattattattcaaatctgctgaacgctgatatattctgctgactttgttgttgctattactgctgaaatttactccttctacctccatttccaggtacataccttttaaactcatgttgtgaaaagcttcaacacggcaaataaatgaagttttggagttataattctgctttctactcatctaagtcctgtagtttaaatttcaattttatttcgtgttggttaactagtagtgaattcaatacgatggctataagttaattgtcttgttttgaaattcgtataaaagtttgtaataatgttgtccatttcgaaatctcattagtatagttatatttgaattgtcaaaatagagaacatggcagaaagttagccattatttaaactttatggtattgttagttaggtatagcataatatggaaatatcaaggaaaaatacgttatcagtttattttattagttaagttagttgttgtttaaagctagatgatattggttgcaatttactctatattttggcataacaatggttatgtttataatcaatagttgaaagatgcattagtaaaatccgctatgttcacaatgtcaaaatatggcaaataatgttgtatgcaatatcattttattaagttaacaggtagacttgttctctttcttaataacaaatggcttaggaatttatacaatgcgaaagttggtgtttagcaataattcacatagattgagaacaaaaaattggtttgattaagtatatcttgaattcaatcaatagcaatcaatcaaaataattaggcctattagattaggaacaagcaatgtggaaagagattagatttataatgtgtaacaagtttaagactgtaaaaataacatttgttgcaaataaaataacgagaattcttcgaaaatatcatttcctttcaagaaatgaattttttaagattcatgagctattcaccttttgagtatacatatgttgtatttaaaaaaaatagtgttaatcatatgtttattcctttctttggatttgaatagcttggaggaatataattcatacgcgaaaaaaaatataattcgcaataaacatttaataaattgtgaattcttttcaagattttaagggtaccttaaatggagatttatcatgatttttacataaaatgtatagatataataaacaatttgtggaaaatccataataccattacaaatattttgcgcgattagggatgcgttcgcgtaacctgattatatttttaaaagcaaaattcggattatgcgttcgcgcaatttcgatcaaacatttaataaaagggatttatccaaggatgttaaaataatttcatatgacccgaaatgtgcagatcactgtttaatcatacaagggcgacggtgtttttaatgttatttctaacttcgaacatatgatttttttaataaaaatataaaaaatattatcaactttttgtgtacacgtatgcgtgacacgattctctgcaattataaaaggtatataatacgaatatacgtacgcgtaattcgtttatataattgtaaacaataaataaaatcggtaacaaaatcatgcaataaaaatgtatttagtaaaatcacgacaattaagccaagaataaaaacagttgagcgaccgtgctagaaccacggaattcggaaatggctaacaccttcttctggattaacagaattccttactcaggatttctggttcgtagaataataaacagagtcatattctcctcgattcagggattaaaactggtgacttgggacgccttaaaattcccaggtggagactctgaaacaaataaacaaatcccgtttcgactgtccttcaattggagaaaactccccaagcgccccgcgggcgcggaaaaaggaggtgcgacaaatattactagagaacatgcctataggatctaaactgccattttaaaagaaaaattgtttgctgtttcattgcattcttaatcaataatagatatcatgcttctaggatatccctattaagcatctaggaaagcctgtagggtgactaaaaccctgtaaactataaaattgcaccttgttatttgagactgctcatattcaacaagtttaaaagaatcagtacgcaagtaggattcagttctttgacactttggtcctaatttaatactgtatgctctctgctcacctagatatcatgttataaggttttctcttaaatacctaaaactgttgtttgagacgtgcacttacttgttatgtttgtggaggtaaatgtgagcctttaattgttccctctttaagtgcagtcctaattgttttgattgacgcttagacttttctcctttaaataccttaagatggtctagaaccacctaaattagaggtcctaaatacctccagggccacaaggaaggcactggtagtgcaagcatatgatatctttcaaggttgctagaacgcgttaggctatgactaaggggagggaattaggtagtaaggatatgatgactatgcgctaatgtcacgtgtatcccctcattgaggagtgattaccgggcattgtgtgagtatgatcatgtaggctaaccaacctagggcccctctttcccaactcccgttgtttaaataaatttacttttctttataaatatgcaacttgttcaagccttttctcttgtttcattacttgaatcatacatgtgcttagaatgtcaaaacatgtttttacttgcaagtacgtgttaaaactgtttatttgttaaaatgactaattcacatagtttatgttcggtcgggacccaccgttgtggaccgcgagtggtgcctaacaccttcccctcaaggttatttagagccattaccctaaatctctggtaatgcaaaatagtccatgaattacttgctcaaggtgtcctaacgcaccaaaatccgttaggtggcgaatcttcgaatacccaatccccaaaaggaaacgagttatttcccccatgaatgtcgaaacccgactttcccatcaaaaaggggaaaaagggggcgcgacaacatggcgactctactggggatattttaggcttttaccataacgaacttatcttttgtgaattagtccaagcatgctctatcccacgtaccatttccccttatttgagtttaactgtctattttcaagcatttatgattcttttattcctgaaactgacttgtctctttgttttgttttctgtaactatcttttaattatttaaataccgcatttatcattttcttacatgcaaatacttgacaacgtgatatttattgctgcaaaaatcatgctcaacatcatattccactcgtgcgtaattaatcctatagcaacgcttgattattgtttgcactcttcctatatatcaccctttaaattcagaaagacatatttgcggtaaaactagtcgatcagtggtgcgtttcactatttcatgcctttccccctcaagttgtccacttgagggtcctagtctagacatctatagtaaccttactctgattaaattgaatatgcatcatggtcaaacctagtctggttaatatgttgtccgcataataactctttaagacaagcctcgtccaaaaatccatcgggttttccataatcccaatggatgtaaccacgattatatgcattaatttggagaaataaatgccaatatgctaatcattactgtataaatagatgaatctggaggaggaaagggcctaactctctttattttgcagaaaatgaggcacgagtccccagattcggtatagttagaacaccctcacttttgctagattggtggagaaaccttcctttatgtgaccaaaaccatgtgaaacgagtcttaggaaacttaccttctctaatggatatccaactcaacaaaatgctgatcgaggatgcaacaatgttttgggacaaggaaagggcagtgttccattttgggatagtcctaatctattgtcacctgaaaatcgcctgctagggaatttctgaaaatggtggggctgaagaagaatgacaacttgaaatgcctaaggactcctacataccttttgagttcctttatgaaagataagatcatagtagtttctaccgtatttttgatgatgagttctcaatcacttatttaggttggattcatcgtagggtcttcgtattcattatgtgttttttgggcatgctggtattcccaatccaaggggataggatccatactaggatggccatggtaaccaaaactctaatggacaggatcgagggggagacatacattatcgtccctatgattgttgcagacatataccgggctttagagcgatgtcagaaagggttcaggttcttcgagggttgcaacttactgctacaagtctggttgttggaacatctccaaaagggataataccgtcaagaatttccgcaaaggtcgtggaatgatcacatagccttctatcatcccaaaaggatgaattatattccagacatgtttgctcagccagaggacgctgcaggatgggtttagctttttgaaaatttgactgaggatcaagtccagtagatgtttgagtggttccctaccgatgaattcatcattagatccagagattttccgcacttggtgttgatcgggttgaggggcatatacccttacgctcctctcagggttataagacaagcaggcaggagacaaatcataccacgggttgccaaaatatgtcactttagagccaatttccaaagtaacgccatcccgtataagaatgaagtgtaacacatgtggaccttaaagattattgtggagaaggatattatcgagccagacagatatcacacgggccactcatacctttacccttcgtggttggaggacaacacaactagggtcattgagccaagggctgggctaggaaacaaggttatggacgaggttgctaaagcagaggtgaggtacaacaagctacggaaaagagttagagagtctgaagccaagcatatggcactgcacaaggttgatatggagatgattaacgagtggaaagaaagatttgttaaattcagcgagaggctggaatacctggagtacagtttaatggagttggaagggaagatgagaaaaagggtcactgactgccagaacgtgaaggaaatgaaggagggcatcttgcaagagcaatcctgctgcttgtcgatgccccctttttgctaaccgtggggtcagaaatcgggtatacgacattgggaggacaactctattccctttagagaattgggtttagaagttaaagagtctccacctaatgattatagtgcattaggacactttaagaagggtttgagatgaagagaccagagattagggtaagggctagaaattatcccgaggggaaggtgttaggcacccctcaagatctactagtgtggtcccggctatgttacaattgttactttacaagtaaacaatcaaggctcaaataaggattcgcatataacattgcaatcatgttgaaaactttcgaaggtaagtagagagggcataaatttatgaaaaagaaaaaaaatatttgagtagttttacaagaagagatgaaagcaaataaagggaggggggtcctaagtttataattaatatggatcacttcaatgcaatacccagaaatcactcctcagaagaggggtcgcacgtgatattagcgcatctgtcaacatatccatatctacccttcccaccccattaaggtgttaaagcgcaaaatggtatcattacttattgcatgccattactcgtcccaatcctatcagtcccggaggcatatgggactcctaatcctaagggggagggagttggggcttttgcggagttttcaaaaggataaaatctaggtgacaaacaataacaaatagcaattaaaagggaaacaaatagcagttaaggctcaagtcagcctcctcattcaaagcagcagattatctagcatgacttacaaatattggtttggtctgtattaaacttaacgtaggaagggtggctaatttatcacatattctttcaaataagaagtctgaatgaggcctgctcactggttgtaattatcaaaactgatacaagtataaaattttaccctaaggcttgcctaggcattaaacagaacctataggcatgatatctattagtttcataaataaagaagtaaactgattgcaaaaaaaagaattgtcaattacagggacataagatctgcggcgttaaacattattgctactgattttaggcttataagcgagttgacaattcaggttcagttaacagctcctatagacatgctttctaggtgttactgatttgagcactgttattgtttatgcaggaatcccataggcaggttgtctacatgcaattgattaggtatttaaatcctataataggttttcctaatgacggatgcagaatgcagaaagttctataggcatggtgtctatatgaagaagcagaattttaaaattggcttacaggcatggcatctgttatgaaatcgtagaaaaccctatagacatagtatctatatgagaatgcagaaaatccgataaatatggtatctatatgagaatgcagagtttcaatgacttataaaatgcagaactttagaaaaaatattaatccctatgaacatggtatctacgtgagtgcataatttcagaagtatagtaattccctatgagcatggtaactaccccttgcatgcatagtcccctacctttttccactagccgaccccaaatgtttattacaagattattacagacccgaatgaattagaaaagaaagtaaaattacatcaaaagttccagctacatctaaacagcctaattcagattcaaagtccaacaatatgagataaactaacttccaagatcagattaccaaaagattttctcatatttggggtgtgtcaaagttcccaagagtctcaaagggactccaggcagtgcttacaccccaaaatattgcagaattaagaacatggtgcagtgtggaaatgccatccctcagatgtccaagtttagagggaactcaaggtcccaaagcaaggctcataagaggggggcagaacttaaaattctaagaataagtgtaagtgcataggggttagagagtgacaaggcaggctagtggttatgcccaaccatatgctaggctggcacacccctggccagcctgtcggccaatcaattatgagtaaagacctattgaaggtcagactagggcctggacagtgattaggacactatcagacaaaagtctcaaactcggcatacatgtaaaggggaatgtggatgggaattgaaagagtttaggactcaagagtgtccagttcatgtccatggacaataatatcaagtattgccatgtttctgaaccataactcaaccaaatagtggggcttagggtttgggattcatataagagcaggaacgatgaaataaacaaacttgcagaaaatcacagcatgaaaacagaaagagataaactatataataaacacataaggggaagagacatgacttgaacataagaacataccagttgcagaaaagtaagcaccgaaaaagcaggattctttcaagcaaatccataatcagagaagaacactttatgcttgtgagttcagagaactcgagctcttatgaaaattctaagtgtatttgagagtgagaagtgatcagaattgatcgcgtcaaattgattctctaaagtgcagaagggcagccccctcttatagtgtagagaagcaagcaagaatggtaagaaaaccttttaaaaatcagtctcaaatattctccctttagccaagggatttaatttcagacggaaaaatgtaaacaaggaaagcaaatttgagtaaaatctttcatagtagcctaagaagggaaaatacatgaagtatatttaaggaaaggtcttaatagtacttgatttgtaaagagaaaggaaagggaatcaatcagaccgttaacaaaatcaaagtaaacaggtttgattcgaatgaacccagtcaggaatagggagagaagggctcaaacaaaaggaaattaagggcaatcaatcaagaccctatcaaaggggtccaaaatcaatcaagcaatcgtcaaaaatcttgaaagaggggtttctcacatataaagcaaacaattcaaacagaatagtctagcattgaagggtttaggatcacaaacaaaagaatatgagttcagtcatagattcatgatgagtttgaaagttcagggttccaaagtggaaccctaatccaatttatcgaagaaacccccaaaatcttgggtttcaaattgaatcaaacacagaaacgagaaggcaagtgaacagactcaaggagtctcatgaggaacaaacagaccacgatagcaggtttgaaacaataagagaaagaaaatcgatttgagagcataaaaggacacgttttggaaacccggagctcaacaagtccagaatagatgaaacatgcttaacaagaacacaaacagagttcagaaaagcaaaagtcaagaagctcggtagtagatacacatggtagaagaatgaggaaagtttaacaccaattaatcatgtgagcacgcatataaaagaaaggaaaaaaagacaatacatgcgtaatagagaaggaaaacatacgagcataagacagacgaacatctaaaagaaaagaacaacaagaatcaaaagaccttaagaaaccctaatttgaaatcgaacgatttttaagaaggaaatttggggaaaacactcaaatcgtcaagaaaagcacagacatagcacagatctaaaaaaataacgatgaaagaacctcgattagcttagggtttcagagaaaccctagaagttagaaaggcttggaagaacatgatcagatcctgagccgaaacggtcaggaatagagcttctagcgcttgaatatgctgaagcatggccggaaaaccatagatctacggatctgagggaggaccattgaggtcaagcctccagacttcgtgcaactcaggcttgggcgtgagagagggtgagtaaaggccatctatggtaggagatgccatggattctggtgggaatgaggtgagataaagtgggaggtgattagggtttcggagaggttcaagaggatttgagggagacgaagagagttagaggtggagtctctatacaaatgaagtagggttaggggtgttaggtgattaaaaaaggaaagcctaaactacagccgttgatcaaaacgatcaacggctaggatttaaagaaaatcggacgggtttaaaaattggtctaaggggtcgggtcgaaatgggaatagggtcgtttaatttggggtggaattgggccaattgagcctacaattgaaagggagaaaggatgttattgaaatagaaataggctaagtgttaaatagccaatttttcttttttattttataaaaatagttataataatttaaaaagtaaattaaaaatactgagcaaaaaatactatataaatatcaatttaaaaatattggaaccagttttataattataaaatgctattaatcataaaataggccataattgtaattacatgtaattagcttaaaaatgccaaataaatttgtaaaaaatatgcaaaaatcaccttaattatattttggtgtaaatacgggaatgaaataagttattcaccaaaaatgataattttgagaatacttattggattttgtggtattaaaataggtagtaaatcggtttaaaaatcattagaaaatactataactcttgggtgtgcttatatatgcacatacatgctattttggaagtattttgggtacaaaaatacatagggaaaattgggtgtgagcacgtgatttttgtttacaggacaattactccaaaagaaatcaaaaaaataataacaaatggccttgctgtacaatttttggaatttacgtggcattttgttagctatttgtggttttgtccgtgtttatttagtcttatcaaacaaaaatacaaaaatatatgtcgtgtgtaagtttaggatatcattctactattaggaattaattcaccattatttggttttaaaaggcgaagatcccaagatatgtatttctgttctatttcttgtcgtcgtagtgattttattaaatgctttaattcgtgtgataaccgtttttaaatgttgattaatatttgggtagtttaattttggttttaggaatttttggtttaaattataagaaggaaatattggatttgggccaaaaatctaaagaaaatcaggcccaaatcaatacaaatgacccagtccaagccaggtcctttagagatgtccaaacgacgccgtatagggccttccaatcggaaccgttcatcccctccaatccaacggctcccaagccttccccagatactcgacccactgaaacccggtttgatctgttcccagcatgagaccaaacgacgctgttcccccagtggaatgatcaaggccgttgatcattggtgatccaatggctaatatcaaaccattcactccgtatataagcttacctccttcaccccgcaccccccgagccagaccccccctcctcactattcttccgtctctctcatttcagagacggacctgggtttagaaccctagccgccttagccccccttcgtttgaaacccggtggcatcaactccgtcggccaccagactaacaccctaggaccactcaaccaccctgaatccaaatccacaaaccattcagttcgaatcttcccccaccgtctcgaatcttcgtttgaagattcgagcccagacctcgacccatgccaaacccccccaaattcataccaggtatccccttgaccttcctcgtgaccaaaccaatcttggtttggtctgaatctacccacaaatcccaaaatcccaaatctgaagattcgaaccctagaacacaagaatttgaggagtctgtttagatttaaacggaagtttggggtctaatagaccctaaacgaagcgttctcggtcgagaacacctcgattaagatctgttcgacctcaaatgggcaaatcaagctcgggcctgggtcatctgtgtttaagcttttctgatttgttcacttttcccttttgttgtctattttagtttagattagtttttcggcatgtttatttagtttgtttgtttattttgggatttctgttgtcaattgttctccatctccataagaccttttatttggtcgattgtttattctgttatattgaatccgtatggtggtatacatatttcaattggattgatatcgtcgaatcaataatgcctgtagtttccctgtgtcgtgcaaattatcgagaacagtttgatgccctatttgttttatttgtttaatagaccaattattccacgttataattagtatagttgattagataaacgacgtcgattagtttcataggactgaatgttcaaatgccctgattctgataagcttcatatgattgatcaaaccattgtcgtttaactgattgtttgaaactatctgtgaatggtttgttggctgcagtacaaaggttggaactcagttaggatagttgtgaatttgaactcccattagtttggattttcagtttgatgaacttagggtaatacggttaataatcagtggattcagggttagtctaaggttgtaaaagctttgaaaagcttaaaggcaagtgggctgacagtaaagtattaaaacattgattcaactaatggaattaattgaccaatagtgggattaatgacatattgagtacctttaatggctggaaaccagtaacaacatgtgttttgtcagaagttagggaattagagtagaaatggacagcatgtgctgtcaggacatgcccacactgcccatatttgcttaattaaataaagacaggccactttagcagtaaagaaagggtctgtcaggggaatctcatgggaagggtttttattttaatccttgagtggaaaaacaggaggagatgggaggggattcagttgttttaacaggctgttgaatgggctgatgctaggctataaatagaggaggtttccattagttaaaaacggttcagagagggagagttctaaaaaaaatcagaaagtatagttctgaaaataggaaggcagaatagttctgaaaaatcaaaaaagataaagagtgctgaaatcataaagagagcaagagtttttaaaaaccaaaaagaagaattttccagggcctgagtgtgttaaaagtgtaggtttcacaacaaagaacttcagttttgtcttctgctcagaaattcaaaatcagaaactactgttttattgtctctgcttgcaatcttagcaatcttcttgtactgttgggatttatcgggcagcctagttgtctgttgatttttaagcactacttttcaagctactggtttcttctttgggttctattctttcctggagattcctgctgctgttgttattggttttactagtcctgctgtactgctgctttgtgtatgctactactgctctactgacttttctgcctcttcaattgtaagcactttccaggtacacatttgaatctcatactgatgtaacagttaaaaacatgaaatgaaagatgcaaagaagtttttatcagtcgatgctttacttacagctttataaatgttgttaaaattgtgtaattctttagtttgtagctcaatagagaacacattagtgagctcgtacttaattgaaatttagttggtctaaaactgcgatatgtggtttgtttagtagaatacatgatgtagctatataattcatggaatgtgcaatcacttagtataattgttaatttgaactccttctccagttatgttttgaatatgtagggcaggtggcttttaaccttgccaaatgtaatacagttttaatcttttgagtttcaactttattggatcccgcttaggtagttaataggacacgttccgaataccattagtagcgtcttctaataagtaattccattaatcttgtttaaatgggttagtttaaattcagcttgagaagcgtttggagtgagtttagcatttaatcaatcttgcatgcaattccctttaccaaattaaaagcatgttcacccatggaataaggcacgaaacaattcccgcctcataaacaattaatcagataattaacaagaatccggagttggccaagcatgcaatttaattagaatgtattttctttcttccatttattagagacgaacataataaagatgtagtcattgtaggtttacccgtttcataaaatgagacgagcctcgccaaatgagatgcacaaactgcggggccctcataaatgtatatattgaatacttacaatctgggatgggtcatttagcgaatttcatgaccctccccaaaaataataacgttatagtctctttaggtgcgttttaataatattacttttcttaaattcgggtgcgcatttatgtgacccaaattcaaatctcaacggagtcgaaatgtgtaaacaactacgggtgcattgattgtgacgtggtttgagatacattttcacgacgttgtaattttataaaaataaatgataataataaaagcggtttaaatttaataaaagcacataagtcataacatgtatttaaatcagatatttagccattataacaatttaagcgaccgtgctagaaccacgggattcgagggtgcctaacaccttccctcgggtcaacagaattccttacttagaatttctggttcgcagacttcatttggaaagtcgaatattttcctcgatttgggattcaagataaaccggtgacttgggacaccaaaagccaaacctttaccaagtgacgactctgaaataaataaataatcccatttcaaatattgtcacttaaattggaaaaactcccctcgcgcatttaaccctccagggcgggcgcgcaaaaaggaggtgtgacagctctggcgactctgctggggaactataacccagaacctttggttcagggttcaagaattcaagcttagaataattgttatatttggctttattatctaatctttattacatgttttgacataacgtgctaaatgttgtcttttactgctttgatattatctgaactgtatataaactgtgccgaaacccttctctcctcacctccggggatgtgcttactggttgagactccctattctgttagtgtcataccctgaaataaaaaagaggctcggacaagttacgaagccggatggccttttggttcccgataagttgccccctcctcgactcgagttgtccactcgggtacacagtctagaacatatacccaggttataaacctagtataatgaaacctcatgccggatccctagtaggaacgtttacttgcatcatgttacatttgacataggggactcaacacaggggttgggtccgtctaggacaggcaacctaaaatgaaaagaccatcttgctgcatcccgtttgttttgcgcatttttttgcttcagatctgcatgttgaccgacttctaaaaaaaatttaaaaaaagggggaaagaaaaatagcagcgtaggggagataattacctatttttggaaaataaaaccaatgtccaagtagtgtcgaaacctcgccggaattttctaaaaaatgaaaacaaaaatttgtcttttagttgatttattcctttaatcactttcaaaatccaaaaaaatatatatttatttaaaaaggggaaaaattcaaaaaaaaatgttgtttctgttgtagtgtctcttttataattcagactaatagtccaaatgcatccctaaaaaagattttctttagtctttatctcttttcaaaaaaaaaaaaaaatccagaaaatatttttttttctttctaaaaaagagtgtattcaggaggggtttagtttatttactctacacttgatccagcccgaactacgccggtttgattctcacagggtgtgagatacgtaggcaaccctcatcgggtccaactttccctttttcaaaaatagccaaacagtcagaattttaatttatgagtcaggtgacgctgttttgtcaagaatagccaaatgttcccgaaagggacgccggaaggctgactttgcacaaagagccattttggtcattttttttaattttgaccaagtggcccaatggccttaggatcctcgtccccgaggatctgcgaggccatgttcccaatatcgggtcaccattctaaaaaaaaatataaaaaaaatacaaaaaaatcaagtgatgctttcgttgtaaaaaaaagccgaatgttcccgaaagagacggcggaaagctgacattgcataaacggtcatctttggtcatcgttttttttcgaccggttgatcctcgcagccttaaaatcttcgttcccgaagtgctaaaaggccgcattcgaaaaccgagtccatcattttacaaaaaagaaaacatagatagttttattttttgagtctaatgaaagtttttcgttggcataatcaccttaataaatgtgcaggatgagcacgatacaaaacaaacccttttcaataattaccaagatcccttttaagttgcgattatggtggaatgacttaggcaaaaaggggcaagacaaagtaaagaagtatctgaaagatctcccggatttactagacattcagcctcggggtgatattatcagatcattggtcacttgctgggattcagcacacaatgtatttcatttctcggactttgagctcaccccgacattggaagaaatagcgggatacatcggaattgatgaagccccgttaaggttcaagtacttgattgcaccttgggccgtcacggtacaccggtttctggatttcctaaaaataccccgaacatttcaccatccagatcttgccaaaggttttgcagtctccacctcatatatgctagatacggccacgtgggcgggtttaatgagccagacttcaaactatgcagtagaggtaatcgacaaaagtgggacgaacacaggttggtagcttttatgacagcttttttgggtcttatagtgttcccaaggaaagacagaaacatcgatctaaaagtaattagggtcgtctgtaccttgctcacccaagataaaagtactctggcgcctatgattatggctgacatctttcgggctctcactgcttgccgagccaggggcgactttttcgaaggatgtaacctattgttgcaaatgtggatgaccgatcatttatgccaccgctccccgctcttgggttacagttcgcccgagaaaacttgtattggagaattctacacaagaatcaaagggtttagtctacccgagggagtcacagcttggacgtcatttttccgaactctcactgccaaccaaatccagtggacgctcggatggttgcctgttgaggaaatcatatacatgccggcaaccaggccccactttttgttgatgggacttaaaagcatccaaccctatgcaccgtatcgggttttgaggcaacttgggaggtatcaagtagtgccgaaagatgaagactggagtacccaagtgatcgaaatcagtccggacggtcgtttccctgaagaagaagttcgccaaatctggagtgagtgccaacatctgacagcaaacacttgtgtgatggatacggctaaaggggaagctgctccggggtatcacgcttggtttagaggtgacatgtcctgcgagagaccagctaaaagacctcatctcaaagatttcgttgagtcatcccaagagcaatggaactggttagcaaagggaaaggggtatcgggcagagatcggtgatttgaagcaataggttgacagtctgaaattcaataatagtatgcaaatcgttgcggatcgaggcgaaaagaatagattgacccaagaaaatgaagaacttagggcccaaatccagaaattgagattggctcttgataaacaaccaaggagtcgatcagacgagcagttgataaaagggttgaaaagtgaagtcagggaatggcgagatggtttagaagagtctgaaaatgtcatggcagagatcaaggtgcagtggggtacaagagcagataagcatcgccgatacttgaatcaattgaaatgcgaccacgagaaaactgttgccaaaatgaagagagagatggctacacttgaggttaaagcagttaagcaagccgaggatttccaaattgatagcagatactgttacgacttgttggcccaaatgaaggtagaagtacggcaactgaagaatcagcatatgcatgattctcaggttttaaaaacgtgcagtgatcagataaaacgcctgctcatagagaagaagcaaaccagagataagatcaggaccattgcccacgccatcatcagacggtgtctacggtgtgaaaacatgaccagcattaccgttctctcggtagtgatgggttatgtcaagcagaccatgcatgagctggaacaacctgaaagggatatcacacctaggaccgcggcgaggccgaacgatgccccgcgggcgccgattctcgaaaccttaatgtattcataggtctagtctgttcgtcttttacatcgaggtgtattagtctgttgagtctgtacctttttcagggcttgttattttccttttttgagagtgttcgtttgtaatcgatcgttcagtaataaaatgtgtgcttcttttacactcatctgtttgaactacgtaatgatctgattcatgcagcatcgtgatacgtaggcaatcctcatcggatccggtcacattttaacttcaaatattgaaaacagtaataaaaaaaagaaagaaagaaaaatgaaaaaaaattataaaggggaagcctaaaaagaagccggaatgacgcatgcttttgttgcaaacatgtaggaattcacttaactgtataggtgcatcatgccccaacgtgagattacctatctgttatttgttttcgaactaaccgttcgtttgtcgttgagtccttccaggttttagaaaaggcggttggtttggtgaaggtctggcctcacattcatacttcacgaggtcgaaatggagtgttcaatacctgttgttaagtcaagagggggtactcacacttacttcacaagatcaaagggaagcatagaaatgtcttcagaaattcctttgccgacagttcctatttccgaggagagttcaatctcgaccgtcctcacgcccgaatccgcaactgcggaggaaaatagaatcctgcggctctgcatgttggaaatgttggatgactagaataacagaaaagagccaccaagtgttatccatgggttccctgagttgttctcctggacaagtcggacttccaatgtccccataagctatccggctaccctgttcggatacccagccatttcggccttctctgctggatcgccctctgattcttatccccggatgtcaacaacagatgtagctacaaacgtattcactgcacctccctgtccgatcgtggcacaacccgctacacacaagccaaattttgactcatcctcattcacattccaagaaccgtccttctccctggaaccaactcggttctccaccggcactcatcctccacagcctcaatacgagtttgcacctgggcaggatcaaagccccaaaactactgaacaaaatgagatggcaaaaagaatgaggagccttgagcagagtttgaaaaacatgcaaggtttaagcggacagaagagtgtctcctataccgatctatgcatgttccctcacgtgcacctacccatgggtttcaaaactccaaagtttgagaagtacgatgggcacggcgaccccattgctcatctcaagaaatattgcaaccaattgcggggagccggcggcaaagaggaattgctaatggcatacttcggggaaagtctggtaggaatagcctcagaatagtatatggaccaagacatatcccgatggcatatatgggatgatcttgccagagattttgtgagacaattccagtataacatcgacattgcaccagactgaaattatctgtcaaacttgaagaagaaaccttcagaaagcttcagagaatatgctattaagtggcgcgagcaggcatcgagggtaaaacctcccatggacgagatagaaatggtcactacttttctccaggctcaagaatcagactatttccagaatatgatgtcagccatgggaaagcctttcgcggaagcaatcaagatcggggagatggtggagaacagtttgaaaacgggtagaatcttaagtcaggcagccataagggcaacctcccaagccgtccaaagcgggtctggaggaatggcaagagggaagaaaaaggaagaaacgtccatggcagaattagaagcaagggaatatcgtaatcccaggccccgttttccagaaagaacctcacaacattactacccccaccaaaatgtgacgtacgctcctcaaccctacatggtcatgaatacccatccctatgtccatgcgccacagcaagccaatcgaggccaagctccacctcccagaaattagcctccctaccgcaaccactataatccacagcctcctcaaaataacttccgccctcaggaaccacctagaagacgaactttcacacccatcggtgaaccatattctcctttgttcccaaagctagtccaattgggtttcctgcagccagtccctcagacaaggcacaatccggcatcacctacttacaaagccggtgttaggtgcgcctatcattcaggacagaagggtacgatacaaataactgttgggatttgagaagggtagtagagaatttaatagagcaggggaagatagtactaagagacgaggaggtcccaaatgtgactaacaacgtgttgcccgctcacaataacgggccgctaattggaatgatttgcgaggacaaagaattcgatcctgctttaaaagctataatcgccatcgtcgatgcagggaaaaggcctaaaaccacccggaagctagagaaaggggaaaagaaggacagtactatcaaggttgagcccaaagagaagggcgaggaaaagacagtgacgatgatgcctgtgaggaataaagttctttacgttccacgaggtagagcagagaagccgcatagcttcgaagtcaaaagggcaaaaccaatgtacgtaccaaaaggggcctatgtggtccagaggacgattcaaccacctcggctgaatgagccagtggttatcggacgcgtgccacaaaagccgatgacaaacccgtccacagtaccgtggaactatcaaagaacgttggttacgtacaaaggaagagaagtcacgggagaacttccagagaatacttttattggaaggtattcgaacactcaagagttgaacaacgccacacggagacgcttcccgccaaagaagcctgtaagcgttgaagaagcggaagttttattccaaaagatgaaaatgccagactatgaagtggtagatcaactaagcaagtgccccgagcaagtgtccatgctatctctgctgatgaggtcgaccgaacaccaaaaaatcttgatcaagaccctgaacgaagcatacgtacaagttgaaacctcagtcgaacaactggaatggatgacggagaggttcttcaccgttaaccaggtttctttcagcaagaacgacttacctccagagggagcagctcacaacaaagccttacatctaacagttaaatgcgaggactacttcgtcaagcgggtaatgtttcatgggggatcaggtgttgatatttgtccgctctccacactgcagagaatggaaattgggacaggaagaatccaccctaataatgtctgcgtaagggctgttgatggcgtcaagagggatacccttggggaagtagacttggtgttgactataggaccagtggagtttgaaataactttccaggtgcttgacatggatacgtcttacaattttctccttggcagaccttggattcaagcggcaggggctgtgccttccactcttcaccaaatggtgaagtttaagtacgaagaccgggaaattgtggtccacggagaagacgaacagtctatttatcgggactcatccatcccatatcttgaaccaagggaagggagcgagcacacgttttatcaggctttcgaagttgtgctagcagagcagtatgaagaaggaagaccttgcccccagcctttcttgtccaacgcctcaatcatggtggctaaagaaatgatccgacatggattcaggtcagggaaagggctcatacaaacattgaaaggaataacggaacccatcaccttgccttccaccaagaaactttttgggataggttttcaacccactccaaaagatgaagagtggtcaaagaagagggaaaatgagggttggaaactgcctcggccattgctagatctatacgaaactttcgtcggaccgaaatacatcgaagaagaagacgatgaggttttcacggccgaagagatcgaggagatatgtggggcaatgagaggaatgctctacgaagctcacatggttcaaccgggagaaggtaccagcaccactgagatgctatatgtggggccgaactccaagcttcgaaactgggaggccacgccattccctactagacaggtgtccgggtagacctgtcctgccacccttcctgcatcacgagttatccccaggatataacttggatgtttttcccttcattgttgttttaaattcctgagttataaacattgttatcttccaaattccaagaaaataaaaatcattgttttctcatttttcctttgttctgatttttgttatttttccttatctcttctttcagttataataatgcggctttaaataatatgacatgcttgcggacttcatgcctagatcacaacgagctatttaattgtgaaataatgaaccaagaaccagaatatgacgaagaagaggcttttagggaaataaaccgagaattggaacactttgagaataaacctaagccgaatcggaatgacactgaaccggttaatttgggaactcctgaagaaatccgagagaccaaaataagcattcacacggatgagaaaacacgagatgcgatagttcaactccttttttaatttaaagatgtgcttgcttggtcatacgatgacatgccaggattaggtgttgatctagtggtgcataaattgccaattcaccctgattgtcctccagttcaacaaaggcaaagaaagttcaaaactgatgtcagtgacaaaattaaagaagagatcaccaagcagctaaaaacgggagtgatcgggtagtccagtacaccacgtggttggcgaatgtagttccagtgccgaaagtagatgggaagactcgggtatgtgtggattatcgagacttgaatagggcgagtcccaaagacaattcccattgcccaacatccacatccttgttgacaattgcgccaaacatgagatacagtctttcgtagattgttacgctgggtatcatcagttgttgatggatgaagaagacgccaagaagactgtattcactacaccttggggcacttactgttatcgggttatgccatttggtctgaagaatgttggggcaacttacatgagggccatgaatgccatttttcatgacatgatgcatcaagaaatagaggtgtatgtggatgacgtgataatcaagtccaggacgcgggacaatcatatccaagacttgaggaaattcttcgagagactaaggaagtacgacttgaagctgaacccagccaaatgcgctttcagagtcccatcaggcaagcttttgggtttcatagtaagcaggagaggtatcaaattagatccaacaaagataaaatctatcatagatctacctaccccaagaacaaagaaagacgtgatgagtctgttgggcaggttaaactacatcagtcgattcattgcccagctgactagcacgtgtgagcccatatttaagctattgaggaaagatgcagcgatcaaatggatggctgagtgtcaagaagcttttgacaaaatcaaagaatatctttcaaatcccccagttttggtcccgccagagccagagagacccctgttcttgtatctgacagacttggaaaattctttcggttgcgtcctcgggcaacatgacataaccggaaagaaggagcaagcgatctactacttgagcaagaaattcactggctacgaggccaagtacactctgttggaaagaacgtgttgtgctttgacgtgggttgctcaaaaattgagacattatctccaagctcacactacttacctcataatcaggctggatcctttgaagtacatatttcagaaaccaatgcctactggaagactggccaagtggcaaatcttgcttactgaatttgacatagcctatgtcacccgcacggcaatgaaagcccaagcgttagcagattatttcgccgaaaacccggttgatgaagaatactaaccgttgagtacttattttccggatgaagaaataaacaccgtagaagtagtctcagaaaatgctcatgtttggaagatgttctttaatggggcagtaaatgccaaaggtgtaggaatcggggcaattttgatttcgccctctggtcagcactatcctgctacagctagactgcgtttcttttgcacgaacaataccgttgagtatgaagcctgcatcatgggcatgcatatggcgatcgatcagcatgttgaagatttattgattatgggagattctgacctgattatccggcaagcccaaggtgaatgggaaactagggatgtcaagattattccttaccgacagcacgtggaggacctcggcaagcgtttcaagtcaatagagttcaggtacatcccgcgatatcacaacgaactagcggatgcacttgctacttggcttcaatgctaccctacccaggcaacacccacgtcgatcccttggaaatccaaatcagggaaagacacggttactgtaacgtaatcgaggcaggatcgtgtacacatccatggtaccacgatatcaagaggttcttgaagacacaagaataccccgaacatgctaccggagattagaagaggactatcaggcggcatgtaggaggtttctttttgagcggcgaggtattgcataaaaggaccccggacctcaatctgctaaggtgtgttgacaccgaggaggcgggaaggatcatgcatgaagtacatgcaggagtgtgcggcccccacatgaacgggtatgttttggcaaagaaaatccttcgagcaggttattactggatgaccatggaaaaagactattttagcttcgttcgaaagtgtcatcagtgtcaggtgcacggtgatttgattcatgcgccccccacagaactgcatcccatgtttgcaccttggccattcgttgcttggggtatggacgtcattggttcgatcgagccgaaggcctcaaatggacacagatttatattggttgctatcgactacttcacaaaatgggtggaagcggtcactctcaagtcagtcgctaaaaaggctgtagtggattttgggcattcaaatcttatttgtcgttttggtattcctgcaactatcatcacagataacgcggcaaacctaaatagtcacttgatgggggatgtatgcgaatagttcaaaataacgcataggaattccactccttatcggcctaaggccaatggcgttgtggaagcagcaaacaagaacatcaagaagatcttgaggaagatgatccagagttcccgacagtggcatgaacagttaccctttgcattgttgggatatcgcactacggtgcgcacgttagtaggagcaaccccttatcttttggtttatgggaccgaggctgtgataccagcagaggtagaaattccttcgctccgaaccattgtcgaagcagaaattgaagatagcgagtgggttaagactcgattggagcagttgactttgattgacgagaaacgaatggctgcagtttgtcacgggcagttgtaccaacgaagaatggcccgtgcttacaacaagaaagtccgacccaggaatttcgaagtgggtcaactggtactgaggcgcattctgccacatcaccaggaagcgaaaggaaaatttgctccaaattggaaaggcccatacatcatcaagaagatattgccgagaggagcgttgtatctaggtgatattgaaagaaatgaccctgaaacagcagtgaatgcggatgcagtcaaaaggtactatgtctgagttatactccagtggtcctgacacatttgagatgataaaggttttattcccactacccaaaacactatcaactctctctataagccctttgagccggttacatttctttggctacctatcaaaaaaaaggaacaaaaagaaaaaaaaaaaaaaaaggaaaaacaaacaaacaaacaaaacaaaacattgattgagcctgaactacgtctgacttgattccgaaaggatacgcaggcagcctctctctggggttcagtcacaccaaaataaaatcccatttaccctgaaattgaaaccggggcacatcaaacggcttagaagttgtagtttcatctacaattcttttaccaagcacaagtccttcggatcaattaccaaaggtagggggagccaagagatatcacgattggaggtcggtacattcagaattgagagaaataaaacgagagagtcttgtcggtgaaaaccttcgggcaccgttgaggcgacgggagtagagaaaccaaaatgagagagattgtttagtaaaaaactcacaaagagtgctatcaagcgacaacaagaagagaaatgagagaggtcgactagcgaaaacccgtaaagggcgctgtcggccgaaaggatgattccacctcaggaagtcttggcaaagttccaccggtttggaaacacagttccgcttttgtttcatggggaaatacaagttcgtgaaggtcgggcgtccagtccaaaaagcatgtcatgtcaatttaaagtcagcatgttttccctcagataagtctttcttgccccgaaagggacacttctcttctaaaatttgctttctccgttctttgttttatttttctgtgaatccctttcattttaactccaagttccagatatactggaaagaataagtggcagggccggtttcatggagtttcgtttcgtaagaagtaaataccccgctttagtggtacgtttgtccaaacccgatggatcatgatgttggctgcattcgaagtaaagccacacacacacacaaaaaaaatacaaatccccacggggtctccctttgtacaaatccccacagggcctccctttgtaaaaatccccacagagcctccctttgtgaaaattccccaaagagtctgccccagctaatccccgacgagtcttccttgtacaaagacccacagagtctccccaataaaaatccccactaaaaatccccaagcagagcgggatgtaagaaccaaagcctcacatgggcaaatcatcacaaaatctggaaaagcgagtctgggcagtccaaaggggtttcgccgttgaatccaatcgatggcagagtttctcaacagaaataaggacgcgacaaagcaattggaacaatcaaggtcaccgaaccaaccgccatttccaaactgacaattgttctttgtttggagaattgaaataggtgtgatccaaggcaaccatgcaagaagcaggtgtcgcccaaaaaaaaagaaatacatgagtgcaagaaacggcttggcaataaggaatccacttaaaagggaagtttccccaaaattctcttttacattttactaaaagaagaaaactcaaaaaagagggtcagttagaatcacgagcattttccatttagctagcattagggatccaaccctgaactgagcatttttctgttagccagcattagggctccaaccctgaactgagcgtttatgttctgtagccagcattagggctcaaaccctgaactgagcattttactattagccagcattagggctccaaccctgaactgagcgtttatgttctgtagccagcattagggctccaaccctgaactgagcatttttctcttagccagcattagggctccaaccctgaactgagcattttttctgttagccaccattagggctcctaccctgaactgagcatttttctgttagccagcattagggctccaaccctgaactgagcgtttatattctgtagccagcattagggctccaaccctgaactgagcatttttctgttggccagcattagggctccaaccctgaactgagcatttttctgttagccagcattagggctccaaccctgaacagagcattttacatttagccagcattagggctccaaccctgaactgagcattttttcatttagccagcattagggctccaaccctgaactgagcattttttcatttagccagcattagggctccaactctaaactgagcatttttctgttagccagcattagggctccaaccctgaactgagcattttacatttatccagcattagggctccaaccctgaactgagcattttttctgttagccagcattagggctccaaccctgaactgagcatttttctgttagccagcattagggatccaaccctgaactgagcatttttctgttagctagcattacggctccaaccctgaactgagctttttttctgttagccagcattagggctccaacccctgaactgagcatttattttctgtttagccagcattaggcctccaatccctgaactgagcatttattttttgttagccgacatcagggctccaatccccgagttgagcacttttccattcagccagcattagggctccaatccctgaactgagcgtttttaccttatggcgacattaggactccaatccctgagttgctttttatagactagagttttccaatcccctcatcaattctgtaagttgttatggcgattaattcacgaaattttcctagtgaaactggggcaaaaaatttcgttcgtttgttttgtttgtctcagcaggtctgacctcgaggcgtatggatcgagatgacctacgggatgagtctcaatccagaataaagaaaagaagaaaaggacaaaaagaagatgttccgaggtgttggaacaaacaaagggcggatcactccaaaatttgatcaaggtcccgaactctgccaatcccgtctcactcaatatcgcagaaataaacaggcgcctacaacttgcaagcattaagattcggattgaagtctacaaacagaatcagctaagacccaagatcaagttgcaaaagaattatagataggaatcttgtaactagcggttgacaggcataaatagttagtccagtttcaatttcctttggttgtaataaggcggtcggtaagcagtagtggcaacagcaacggcagtaacggcaagcattgcaatcccatggtagtcccagctaccaaagtttcccgaactacattgacctgattcctgtttagcccaggatatgtaggaaatattcgaggcaaagattcggtcaaatctttcaaaaatgcgcttcacacggagtattccaatatgcaaaatcgctcatatccgctcactttatttttgtacggaaactcttcgtgtgttcgcacaaagaggggcagctgtgagcacgtgatttttatttacacgacaattactccaaaagaaatcaaaaaaataataaagtggcgctatttcagccatgcaggattgagacagagcttagtctcggaatgcagagaagtagccttatgcaatgcaagaaatgcagatggagacagagcttagtctcggaaggcagaaaggtagccttatgcaatgcaagaaaagtagatggagacagagcttagtctcgaaaggaagataagtagccttatgcagatgatgatggaggtagagcttaacctcggaaggcagaaaagtagccttatgcaatgcaaaaatgcagatggagacagtgttagtctcgaaaggcagataagtagccttgtgcagatgatgatggaggtagagcttaacctcacaaggcagaaaggtagccttatgcaaaatgcagatggagacaaagcttagtctcggaaggtagaaaggtagccttatgcaaaatgcaaatggagacagagcttagtctcgaaaggcaaaaaggtagccttatgagatgcagatggaggtaaagcttaaccttggaaggcagaaaggtagccttatgcaaaatgcagaaaaatgcaagatggaggtagagcttaacctcggaaggcagaaaggtagccttatgcaaaatgcagaaaaatgcaggatggagacaatgcttagtctcggaagctagaaaggtagccttatgcaaaaatgaaaatggagacagagcttagtctcgaaaggcagaaaggtagtccttatgcgatgcagatggaggtagagcttaacctcgaaaggcagaaaggtagccttatgcagtgaaagaatataaaaggatgattagtagtaagatctcttagctgatagccgattacgacaatatgactgctggggatattgtatacggatagcaattgtggacaagtgatgattctgagaagttgtattcttgagagtacataaatatacctaatgatgttgcgaattgagtgcctgcatccaaagaaaaatcgtgagttctgtaaggggaaaggttagttcatcttccccgggctcttgacgttgtgtgtcattggggtagcgtcgctaaacaacagcaatccggataatagttatgcatgctttagtaaatatataatcaaaaatagttttctttagatgaaccaacgactacaacgtggttgcagacattgcaacctctttcgcttcggaattttgaggatccttctcaaaattctgccctagtttactgtgctggcgctcctggcgatgcgtggactaaaatcaacttcgaaattttgagggtcctcctcgaaattctgccctagttccaatagaggtgaaaatggaatttttattaaattatgactgaacccatagggctgcctacgtatcccctcttaaacgggaatcaagccaggcgtagttcaaattacatcatagaggaaatcataagtggttacacataatatcgtttcactgcatctgaattgattggcttcggccagacttctccatccatctctgcaagaataagggctcctccagttagaactcggtggaccatgtacggaccctgccaattgggagagaacatccccttggcttcatcttgatgtgggaatattttcttcaacaccagctaccccggtgtaaacttccttggcttaacccttttgttgaaggatctggacattctgttctaatacaactgaccgtggcaaaccgcattcatccttttcccatctataagggctaactgctcgtagcgaccttttacccattctgcatcatccaattctacttcttgtatgatccttaaggagggaatttctacctcggcggggatgatcacctttgtaccataaaccatcatgtagggagttgctccgatcgatgtgcggactgtagtgcggtatcccaataaggtgaatgataacttttcattccattgtttgtgcctttcgaccatcttccttagtatcttcttgatattcttgttggctgcttccacaactccattcatctgagtcctgtaggttgtagagttcttgtgtttgatcttgaaagtttcatgcattgctttcatcaagttgctattgagattggaaccattatcggtgatgattgattctggaactccgaaccgacaaacagtgcggtcgccgcggacgaaacctgccacaaccttcttagtgaccgccttgtatgatgttgtttcaacccatttggtaaaataatcgattgccactaagattaacctgtgcccatttgatgcggcaggctcgataggtccgataacatccattccccaagcggcgaatggccatggtgagcttgttgcagtaagctcgtttggaggtacctttatcatatctgcatgtatctgacagcgatggcatttgcgaacatactggatacagtctgtttccatagtcatccaaaaataccctgctcggagtatcttctttgctaagacaaaaccgttcatgtgcggcccgcaggtccctgcatgcactttatccaatagcctagatgcttcttttgcttcgacataccttggtaaacccaaatcgggagtccttctgtataggattcctccgttgtgaaagaagttgctggataacctacgaagtgtgtgcttctgagtagcgttggcaagttctggatattcccctgttgtcaagtactccttggtgtcatggaaccatggttttccatccgcctcttccttaacgtgggcacaataagctagctgatcatgaatctttactgggatgggatcaatgaaatttgtatctagatgctggatcatggacgataaagtagctaatgcatcagcaaactcgttctggactctagggacttgctgaaattctgtctttgtgaaccttttcctcaactcctgtatatgatgcaagtagggaagtatcttagagttcttggttgcccactctcctcgaacctgatgtatgagcaagtctgaatcccagattactagcaactcctgaacgttcatgtcaatggccattttgagccccaagatgtaggcttcatattcggccatattattggtcaagggaacctgagcttggcagataccgggtagtgctggccgatttctgatagtaggactgcttctatgccaactcctttgaaatttgcagctccgtcgataaacaacctccaaccatcatagtattctgcaatatcttctcctatgaaagatacctcttcatcgagaaaatacgtttttagggctcgtattctccgtccacgggactctcggcgagatggtccgccaagacttgccctttgattgctttctgggtcacgtaaacaatgtcgaattcacttagcaggatctgccacttggcgagcttaccagtgggcatgggcttctggaagatatacttcagagggtccattctggatatgagataagtagtgtaagcacagaagtaatgccttaacttctgcacgacctaagtcagagcatagcaacgcgttctaaaagagaatatcgggcctcgtacggtgtgaacttcttactgagatagtagatggcttgctcctttctccctgtttcatcatgttgtcctagaacacaactgaatgctctatccgataccgcaaggtaaagcaataggggtctttctggctcaggcggaaccaagaccggcggcgttgacaggtattccttaattctgtcaaaagttttctgacaatcattagtccatttggtagcaacgtccttcttcaacattttgaatataggttcacaaatgaccgtggattaagctatgaaccggctaataaagttgagtcttcccaggaaactcatcacttccttcttgttctttggcggtggcaattgttggataactttgacctttgatggatccaattatattcctcgaaaactcacgatgatacccaataattttccagcaggaaccccaaatgcacacttggcagtattcagtttcaaattgtaccttctcagtctattgaagaactttcttaggtcttccatgtgatccctggctttcttggatttgatgatgacgtcatccacatatacctcgatctccttgtgtatcatgttatgaatgatggtagtcatggctctcatataggtggcaccagcgttcttcaaaccgaacgacatcattttataacagtacattcatcatggcgtgatgaaagccgttttctctgcatcttcctcatccatccatatctgatgatacccatcaaaacaatcaataaaagactgcaactcatgcttggcgcagttgtcgataagaatgtgtatgttaggcaaggggaagtcatctttgggactggccctattaagatcccaatagtcaacacaaactctaactttcccatccttttttggcactggcacaatattggctaaccatgtcggatactctactaccctgagaaccttggctttgacttgcttggtaacctcttctttgattttcaaactcatgtcgggtttgaatttcctgagcttctgctttaccggcggacatgttggatttgtttgcagtttgtgagctacaatggatgtactgagaccagtcatatcatcatacgaccaggcgaatatgtcttcatattcctttaggaattccgtgtactctttcttttctgatggtgataggtgaacacggatgcgcgtttctttgacgatctcactttcatccaagttagacttaggcctattctcaaaattctcaacctctctgacgacctcttctggcatatcatcctcttctgaatccatatccgtttgttgcgttgtctcgttgcgagtcacaatcattggttcatcgtcaaggcaaataatagtaatgttgtgtaaaataaagtgaatgatagaaaaaaaataataagagcgagatatataataaattgaaatgcttcgattgaattcgtaattgttttgagtatcagagctcttttcaaaattaaagacaatgcggaaataaaatcagctagtaaaaagtaaaatgtgatgcatggtgcttttgtccagccttgctaccccgaaggtttccgggccctggtggttctgatcgaccaattgctgaggtgctctccttggttcacaaggagtccatatcatccccttcctccccttcctcctcgaaaataacacagcagtccatatcatcattctctaagaacagattcttcatggctgccaatgcttcctcttcctccgacccatatataatatctgccggctggaaagtctgctctaggtgaggtatcagatgctccagtgggtagtagggaccgcgccatggtggcgaccagtgattgaactcctcccaagtgtactcataccccaaaccaaatgtagtgccatgtttcttcagcttgatgggtttggcgattccctggaggtttttgccgagtccctttccaggttcgtatccacaccaattcaggatactttcaatcttgttatcccaccatttatctttgtctacagcattgactctttcaatgtggtggtatgtttctccgcctattctccttctgcctccaatcatcgggatggtctggcgactatatatggggttgctaccatcgctatgaatgatcacctcctggtgattccattcgaacttcactgcctgatgcagggtcgatgctacagctccagcggtatggatccatggtcgtcccaacaacaaattgtaggatgctgggacatctatcacttgaaagtcaacatcgaaccaggttggccccatttgcaagcataggctgatttccccgatagtagacctttgggacccatcgaaggctttgacattgatggccccatctttgatttcacgtaggctctttcccaatgttctgagagttatcaacggacagatattgaggctggagcctctattgatcaagactctagtgacgaagtaatccgggcattgcacggtgatgtgtagggccatgttgtgactcagtccttctggcggcagctcatcttcgtggaaggtgattttgtggctttccagtatttgtcctatcatatttgccatttctcccccagttatgtttctgggcacataagcttcgctcaatatcttcatcaatgcctttttatgtgcgtcagagctctgtagaagagctaggatggatatctgtgctggtgttttgttcaactgctcaacgatcgaatactccatagcttgtattttcctccaaagatcatcgggaccagtttcagtagttcgtcccgaggcttgcttactgcactcagctaggtgctctggagtgtaaaccctgcctgttctggtcatactctgcacaacaattgcttctcccatcttggtctttcctttcctccttgtttcagctgtgtaatcccatagtatggcatttgagtggaattgtgttatgcctgacattgctacagggatgagtaccctcggtggtaacatagcaacttcaaagagtacatgtgcctttggagccccaaattcaacctcaattggcccgtccaccttcgcagaagaaggtgcttcaaattcgagaggcatagacatggttacttcatcgccccaggagggctggttttgcacaataatctggttaagtgtgacttctggtttctttggctcatcattctcagcaatcagtcctatcgatccctcagggtcccagtcatcttcgatctcgatcatgtgaatgtcctcagctctgtgatcaggcagagggttgttgcggatattagaagtaggctactttgctacgataaccttattgtccatcagagtttgaatcttgtccttcaacgagcggcattcgtcaatggtgtgacctttcataccggagtggtacacacatgtcttattagggttgacccactgggaaggattttctggagttatggtagggataggggagatgtaaccagtagctttatgtttctcatacagttggtgaattggctcagcgatggttgtatattgtctgggaggtttgcagtcaaaatttggtctggatcttgggaaattttggcgagtgggaggtgattggtagtgagagggttgggcattataagcttggtaaacaagtgcaggttgagagtatctgggtgaagtgggttgatatgtaggaggtggagatgattggtaaacgggtggtggattttggtaagagggtgtggatgcttggtaattcgggataggttgatatgtaagtggaggggacgggtaagtgtggtattttagtggtgatttgtctccctgtgcgaccatcacggcattgacatccttcttcttagacatgccaccagactgtaaagctttgttggtagcctgcaatgcttcaagatttgtaaccataccattcttaatgccttcctcaattctttctcccagcttgacaatatcggagaatttcaggccctcgatcagcatcaacctctcgtaatattatgggtcctgagcccgaacgaagaatctgttcatttgttcctcttctagggctggcctgaccttagcagcctctgatctccaacgagtagcatactcgcggaatgtctcggtaggcttcttcttcagattctggatgtaaaatacatccggtgcattctctgtattgaatcggaacctatccatgaaatccgatgccatacctacccatcttgtccatttctaggggtcctaactgatgtacaaggataaaacatcccccttcgggcttctcataaagaatttcatacggattttctcattccttccgactccgaccagcttatcacaatatgtccttaaaaggactctgggatctcccgtgccatcgaacattttgaacttgggaggtttgtatcccttcgaaagttcaacatctggctgaatgtagaggtcttcataattcagcccctctatgcctctgtttccttccatgccctggactcggttggtcaacttcttcagttctgctgccaagtttctgataagagagtccttgtcatcagacttaggtgcacttgatattggttgagtgtagtggggtatggtatctacgtagataggagtgttgtggggatggtcgtttatggtgttcggtggttcaggaatgagtagtggagtgtggcatgtattgcaatgttgagcatgagtgggttgcatctgtggttgtggggtgttctatggaggtgcgggattttgagcatttggaaagttgacatcaggagcggtgagagtgaatgataaatttgccaagtttcgaacttgatccagttcttcttggaacttcaacagtttctgctcaagttgggcagcagtttccttagcaaccggggtaccctgaggaatctcaattctttcaatttccaatctggcgcttgaatctcctattctacctttattcttgttccggataggactcggaggaggaggaggtggagggcccttggatctcgtactgtatgatgatggtgccagaatgcacgaactaacctttgggaaggggaataataataaaaaggtaacaagttagcgcgaattatgaggaaaaatattgcagtatttaaacatattgtgcaagaatataaatcatgtcctaatttgggtgccttattgtgcccgaggtaggcctagcgacaagttaatttggagaacttataatgctaaatgcctcattttattgacaaaaaataagacgaatcccaaaatgacactaaaatagcggaaagtaaaaatgtcattaatggccatcagccttattacatcattaaagcaaaatgaaagacttttaactacttggtcccagaaggaccttccccagatttggtatctttatccccctcgaatagcttcaccagctcgcgcagtcctagcagcagataagcttgggccaaatgtccgcctgcattcccttcagcgttccgacaatcttcaattctcttgaggaactttccttctagctccactagaccccgctccaaataccctagtcatttgttgaagctgacagccatatccttccatttctcgatcaatttttgatgggcttcttgtatttcccgatgctcactttcacactctcgaattctcttgcgcagttgattgtacttaacccgtgcttcggctttctcgtctatgattctgtgttcgtgaatgaacccgggttgacccataccattgtgattatcttccaaccaacccgaatagtgcggcacgcaaccagcgtgatacctgtctggctcaatagattctttccccaaaacaagcttgcaatgccacatgtgttgagcttggcatttgtgagggctatcatcgtcctagaaatcagccctaaagtgactcattttgtcaaccattggtatcatttgtttccttccagcctgtctcatggctcggaggggaatgtagggataagttcctcttaaaccaatgagtatgagaaatagtgcatctcgggatcgaacaataaattcttctgtagggaaccattcgaccatccactgtacctggtcttcttttagattctcaaatagctccacccatcttccagcgtcttctggctgagcgaacttgttaggcatataattcatacgccttggctggtggaaggcaatgtgatcatcccagtctctgcgtaagatctcttgtcggtattatcctttctggaggtgctccatgagctagagctgaagtaataaattgcatccctcaaaattactggcttttcgctgacagttttccagagcccggtatatctcagcaacaatcatgggcaatagactgaaaggctgtctgccaattccttccatcagagtcttggttaccatggccagtctggtgtggatcctagccttcttcatagggaacactatcatccccaggaaacaaaacatgaatacgaagacccttctgtgaatattccccagtgaggtgaaggcaaattcatctgagtaggtgcggtatgacttgctatggtcgtacctctcatacagatagtcgaatgggatgtaggagtctttcaaacaggtcaagtctgggttcttcttcagtcccatcatcttaaggaaacccctacccttgcgattctcttgtataagcaaacccggagtctcccaaggaataccagctaagcctcctatttcttcgagcaaaggagtcatttcaacgttcccaaaacggaacacagacctgtcactatcccagaacagagttgcagcctctatgattttgttgtcaggctggatttctagaagagaaggcatattccctaagtatttggggacgagtgtctgatcactggagtggagatcttcccaccaattcagcagccttggatgaatattggttaccatgccaaatctaaggactcattttctgcaaaacagagtgttagacccttacctcgccagactcgactatttaaaccaataattagcataaaaagcatttagttctccaaataaatgcacagaacatgtgggtgtccatttgggtttcagggaaactcgatggactttggacaaggctatcttaatgagtcattatgtggacaacataactgactcggctaggtttgaccatgatgcatgcacagttagacagagtaaggtttctattggggtattaaacaggtacccttgagcggacaactcaagaggaaaaggcacggaaccgtcgactgcaccgctgattgactggttttaccgcaaatacacctttgtcgaatttaaagggtgataatattggaagagcgcaaccactcattataagcgttgctatggtatttgtttggcacgagtggaatatgatgttgaagatgcagtttacaagaatgaaacaaattgacatgtattttcacgttcataagataaatgattataataattgcagtaattacaacagtattgaaataaagcagtaaaggaaagaagataaaggaaagaaaagacatgaagagccaagtcaatttcgtagcgaataaaagacagtaaataaagcaattaatgagatagtaaagaaacaagcaacatgcaatggtaaaagcctaaagaatccccaccagagtctccatgctgtcgacgcccccttttcgctaaccgtggggtcagaaatcgggtatacgacattgggaggacaactctattccctttagagaattgggtttagaagttgaagagtcgccacctaatgattatagtgaattaggacactttaagaagggtttgagatgaaaagaccagagtttagggtaagggctagaaattatcccgaggggaaggtgttaggcacccctcaagatccactagtgtggtcccgaccatgttacaattgtgactttacaagtaaacaatcaaggctcaaataaggattcgcatatcacattgcaatcaggatgaaaactttcgaaggtaagtagagagggcagaaatttatgaaaaggaaaaaaaatatttgaatagttttacaagaagagatgaaagcaaataaagggagggggtcctaagtttataattattatggatcacttcaatgcaatacccagcaatcactcctcagaagaggggtcgcacgtgatattagcgcatcggtcatcatatccatatctacccttcctaccccattaaggtgttaaagcgtgaaatggtatcattacttattgcatgctattgcccgtcccaatcctatcagtctcggaggcatatgggactcctaatcctaaaggggagggagttggggcttttgcggagttttcaaaaggataaaatcttggcgacaagcaataacagatagcaattaaaagggaaacaaatagcagttaaggctcaagtcagcctcctcattcaaagcaccagattatctaacatgacttacaaatactggtttggtctgtattaaacttaacgtaggaagggtggctaatttatcacatatattttcaaataagaagttcgaattaggcctgcccgctggttgtaattatcaaagctgatgcaagtataaaattttaccctaaggcttgcctaggcgttaaacagaacctataggcatgatatctattagtttcagaaataaagaagtaaactgattgcagaaaaaagaattgttaattacagggacataagatctgcggcgttaaacattattgctactgattttaggcttataagcgagttgacgattcaagttcagttaacagctcctatacacatgttttctaggtgttactgatgtgagcactgttattgcttatgcaggaatcccataggcaggttgtctacatgaaattgattaggtatttaaatcttataataggtttgcctaatgaagaatgcagaaagttctatagccatggtgtctagatgaagatgcagaattttagaatcggcttacaggcatggcatttgttatgaaattgcagaaaaccctatagacatagtatctatatgagaatgcagaaaatcctataaacatggtatctatatgagaatgtagagtttcaatgacttataaaatgcagaactttagaaaaaacagtaatccctatgaacatagtatctacatgagtgcaaaatttcagaagtatagtaattccctatgagcatagtatctaccccttacatgcatagtcccctacccttttccacttgccgaccccaaatgtttattacaagattattacagacccgaatgaattagaaaagaagtaaaattacattaaaaagttccagctacatctaaacagcctaattcagattcaaagtccaacaatatgagataaactaactttcaggatcagatttccaaaagactttctcatatttggggtgtgtcaaagttcccaagagtctcaaagggactccaggcagtgcttacaccccaaaacattgcagaattaagaacatggtgcagtgtggaaatgccatccctcgtatgtccaagttcatagggaactcaaggtcccaaagcaaggctcataagaggagggcagaacttaaaattctaagaataagtgtatgtgcacaggggttagagagtgacaaggcaggctagcggttatgcccagccatatgctaggctggcacacccctgaccagcctgtcggccaattaattatgagtaaagacctattgaaggtcagactagggcctggacagtgattagaacactatcagaccaaagtctcaaactcggcatacatgtaaaggggaatgaggatgggaattgaaagagtttaggactcaagcgggtccagttcatgtccatggacaacaatatcaagtattgccatgtttctaaaccataactcaaccacatatgggggcttaaggtttgggattcatataagagcaggaacgatgaaataaacaaacttgcaaaaaatcacagcatgtaaacaataagaaatgaactatagaataaacacataaggggaagagataggacttgaacataagaacataccagttgcagaaaagtaagcacagaaaaagcaggattctttcaagcaaagccacaatcagagaagaacacattatgcttgtgagttcagagaactcaagctcttatgaaaattctaagtgtatttgagagtgagaaatgatcagaattgatcgtgtcaaattgattctctaaagtgcagaagggaagccccctcttatagtgtatagaagcaagcaagaaatgtaagaaaaccttttaaaaatcagtctcaaatattctcccttcagccaaaggatttaatttcagacggtaaaatgtaaacaaggaaaggaaagttgagtaaaatctttcatagtagcctaagaaggggaaatacatgaagtatatttaaggaaaggtctcaatagtacttgatttgtaaagagaaaggaaagggaatcaatcagacagttaacaaaatcaaagtaaacaagtttgattcgaatgaacccagtcaagaatagggagagaagggatcaaacaaaaggaaattaagggcaatcaatcaagaccctatcaaaggggtctaaaatcaatcaagcaatcgtcaaaaatcttgaaagaggggtttctcacatataaagcaaacaattcaaacaaaatagtctagcattgaagggtttaggatcacaaacaaaagaatacgagttcagtcatagattcatggtgagtttgaaagatcagggtcccaaagtggaaccctaatccaatttatcgaagaaacccccaaaatctagggtttcaaattgaatcaaacacagaaatgagaaggcaagtgaacagactcaaggagtctcatgaggaacaaacagaccacgatagcaagtttgaaacaatcagggaaagaaaatcgatttgagatcataaaaggacacgttttggaaacccggagctcagacaagtccagaatagatgaaacatgcttaacaagaacacaaacagagttcaaaaaagtaaaagtcaagaagctcggtagtaaacacacatggtagaagagtgaggaacatttaacacggattaatcatgtgagcacacatataaaagaaagaaaaaaaaagacaatacatgcataatagagaaggaaaaaatacgagcataatacagacgaacatctaaaagaaaagaacatcaagaatcaaaagaccttcagaaaccctaatttgaaatcgaacgatttttgagaaggaaatttggggaaaacaatcaaatcgtcaagaaaagcacagacatagcacagatctaaacaaataacggtgaaagaacctcgaatggcttagggtttcagagaaaccctagaagtgagaaaggcttggaagaacaagattagatcctgagtcgaaacggtcaggaatagagcttccagcgcttgaatatgctggagcatggccggaaaaccatagatctacggatctgagatggatctgagagaggaccatcgaggtcaagcctccagacttcgtgtaattaaggcttgggtgtgagagagggtgagtaaaggccatctatggaaggagatgccatggattccggtggaaacgagatgagataaggtgggaggtgattagggtttcggagaggttcgagaggatttgagggagacgaagagagttggaggcagcgtctctatgaaaatgaagtagtgttaggggtgttaggtgattaaaaaaggaaagcctaaactacagtcgttgatcaaaatgatcaacgactaggatttaaagaaaatcagacgggtttaaaaattgggctaaggggttgggtcgaaatgggaattgggtcatttaatttggggaggaattgggccaattgaggctacaattgaaagggataaaaggctattattgaaatagaaataggctaagtgttaaatagccaattttcccctttttattttataaaaatagtaataatgatttaaaaagtaaattaaaaatactgagcaaacaaatactatataaatatcaatttaaaaatattggaaccagttttataattataaaatgctattaatcataaaataggccataattgcaattacatgcaattagcttaaaaatgccaaataaatttgtaaaaaaatatgcaaaaatcactttaattatattttggtgtaaatacgggaatgaaatcattaaaaatactaaaacccttgggtgtgcttatatatgcacatacatgctattttggaagtattttggatacaaaaatacctaggaaaaaattgggtattaacactgctgaacttgcgcgagttgggagagttgatcgacaagagcatctagtcttgagagggtccttctaggaccaaatagattagatttatttgctttcctttcaaatgtaataaggccaagagccattagtgacatcatcttatttagtttcgtttttgttcatttactttgctttaatgaaataaggcattggcactaaagttctccaaatttatttgtcgctaggcctacctcgggtacaacgagactcccaaattaggacacgaatttacattcctgcaatatatgtttaaatattgcaaacatttcagaatccttaatgacttatttaccttttcatttttttatttcttattcccatcccctaaggttgattctctcatactggcatcatcagcatatcacaccagatctagatgccatccacctcctcctcctccaagtaatacaaaaggcaaaggaaaagtaaaaatggacgatttaagtggtattcgaaaggagaatgctgagaaaatagaagcttcagatgatgggagtacccccacaccaaatgacctagtcttgaggttggcacaaaagatattagaactatagggagaacttgagcaggtccgcaacttggcaaacttgtcactcaccttgaatgtccccgacatcaaccaacaaaacacaaaaacccagcacctccccaaaacacaccaagacaacatccacaaaaccctcttgcaccacattaacacgcaatcccaccccaaaatctcaatcccctaccaatactaactccgccgcaacaccaccatcaaccaattcatttcccaccaaccgtcacttatcatactccctagaatacaccacaacccactcttgaccctcaaaaccctactaatgaccaccactacaccccgacactcaccaaaacaacaccatatatgtggtaaccgtgcctcactctatccaaccagtctccaataccctagaatcctccgagaaggacctgctcattaaaaatatggctaaagaactcaagaagttgacgagtcgagttcagggtgtcgaaggcgacaagagaatagaaagtttgaactataaagacctatgcatacagccaaatgtagaattactggagggatacaaacatcccaagttcgagatatttgacggcacaggtgatcccagggtctatctgaagtcctattgcgacaagcttgttggggtcgtgaaagatgaaaatatccagatgaaactctttatgagaagtcttactagagatgctttgtcctggtacatcatccaggatcccaagaaatggtccaattgggtgagtatggcatcggatttcatggaccggttcaagttcaatacagagaatgcaccagatgttttctacatacagaatcttaagaagaaacccaccaaaacctttcgcgggtatgctactcgttggaggtcagaagcggccaaggtcaaaatgaacaagttcttcgtcagagcacaggatccgcagtattatgagagattgatggttattgaaaaccataagttcctctgatatgatcaagcttggggaaagaattgaggaaggcatcaaaagcaggatggtaacgaattttgaggcattaaaggccacaaataaagtattgcaatcaggcggcatatcaaagaaaagagacgttggggcagtaatggtagctcaaggcccgaaatctccacttatatatcaaacacctccacccacatatcagacacctccacccacataccaagcaccactgcccacatatcaacccttatctcccagatattcccaaccagccactgcctatcatacctataattcccaaccatcccatttccaatcacctccaactcgccaaaattttccaagatcacgaccaaactttgaccgtaagctacccaaatagtacactactattgctgaacccatcgaccagctgtatgaaaggtcgaaaaccattgattatgtcacccttattcctattgtggcattagagaacccatcccaatgggttaacccacacaaaacctgtgcataccactccggtatgaaagggtaaaccattgatgaatgtcaaacattgaaagataagattcagacgctgattgacaacaaggtcatacaggaaaaagaagccacacccaatgtctgcaacaaccccctccctgatcataagggtggtggtatacatgtgatagaaatgaactaagactgggatcctgaggggtcaatcaggcttattcgggaaggcgatgactttaaacttgcagtcacactcactcccatagtagtacagacttaggcaccaattgaagttgaaataactgcatcagttctgtttgaggtagaggtaactccgcctgcggccacccctgttccatttgaagtagaagtggccacaccttttacgatgacagtatcaaccacacctcctttcgactcaaaagcaataccttgggattatgttgccgaggttaggcgaaaagggaaggcgaaaatggaggaatccgatgttgcgcaaggaatgaccaggaccgggagaatctatacacctgaacatttgggaggaccaagtaaggatgctgctaccaagcagcctgtcattgaaacatgaccagatgacctttggaggaaagtgtaagcaagggaatattcccttatcgatcattagaacaaaaccctagcttagaagaatgctttgatgaaggtgttgagtgaaacctacgtgcccaacaatatcatctgcggagaaatggccaatatggtagggcaggtactggaaagtcacaagataatcttccacgaatatgagttaccacttgaagtgttgaatcacaacagagcattgcatatcacagtgcaatttgaagacaaatccatttccagggtcttggttgatggaggttccagcctcaatatttgtctgttggatactctgaaaagactgggcaaaggtttccatgaaatacaggtagggagcatgaatgtgaaagctttcgacgggtcccaaagggccacgattagagaaattaatctttgtctacaaatggggccaacttggttcgacgtcgagtttcaggtgttcgacataccggactcatacaatcttctgttgggccaaccatggatccatgccgctggggctgtggaatccatactacatcaagctgtaaatttgaatggaaccatcaggaggtgatcattcacggagataggagtaaccttatttacaccagtcaaaccatcccgattattggaaatagaagaagggtgggaggggaaacataccatcatatcgaacgtgtcaatgcctatcacgacccggaattcccaccttctggagtcgtgatggaacctacccatagaagctaggcaagccacaaacttagaaatctttaacccttctattttagtcctttttacaacttatattaacaagtgataagcatctaaatgatagcggaatatgagatgtaagcggaagtcttaaatgaatataaaaccaaaatgtttcgaaagtcaacacatgcctctacccagaaactggtgtcacaatatccacggactactaagagtactacatacaatagtttgaaggaaaaataacactatttgtctcggatacatgagataacaaaacataataaaagatagaggagacgccgggcctgcaggactgcctcggaatctctgtggactgaaggatggctcctaagctactaatttaatgctaccgaccctatgtgctggtaagtgcctgacctaaccccagcgaggtattgacgaggctaggaccagactccagataaacctgtgcagttatataatgtatggcggaaaataaacatgaattaatagtttaaaatgggagggggtacatgcttcgggaaagcatatcaagaccaacggaaacttaataaaatatgaaaggacaactcaatatctacaacaatacaataacaatattgttgtggcacgcaacccgatgccttatcatttaacattgttgcggcgtgcaacccgatccacatatatatagttgttacggcgtgcaacctgatccaatataatatatgttgtgatgtgcaacctgatccaatataatatatattgtggcgtgcaacctgatccaatataatatttgttatggcgtgcaacccaatccaatataatatctattgcggtgtgcaatccgatccaatataatatctgttgtggcgttcaacccgatccaatataatatctgttgcagcgtgcaacccgttccaactatacagtcaacaataaccataattaaccgtcccaacaaggaatcaacaataaactacactatctcggcaagggaactcaacagtacaagtatatacgtcccggaaagggagaatcaattataaccaatcttaactcaactcctactcgtctcaattaccaccgtttctcaatcgcaagtagattccacgacaaacaaactaagtctttgctcaatatcaaggatttagtcactatttcaaccatattaacattcaaaaatacaacaagtatcaatttaagattcatggtcatgcttgacaccaacgtatagatactcgtcaccaaacctatatgtcatactcaacaagaagaaaatagaaaataggactcaactcctaatacctcaagctagggttataccgaacacttacctcgatgccacgaacacaactcaaggtttaattgtaggtttaccccttgattccaccgccaatttgctcgtatctagtcacaaattacttaattacatcaataaacgctaaatgaatcaatttgaatgcatgaaaatgagttttctaaagttttaccctaaaagtcaaaaatcgccccctgacccacatggtcaaaattcgaggtagaaccaaaacctgattacccattcccccacgaacccaaatatatgatatttttgaaaaacctaggttctacccaaaacactcaatttccccccatgaaaatcattgatttgaagttgaaatcatgttaaaatatgttaatgattgaagaaaactagttataatgacttacaattgatttggagtagaaaggttgtttgaaaaatcgcctcttatgtttttggggttttgaaaaatgaaaaatgactgaaaatcccgtctatttatacccctctcagaccctatgtgcggaccgcacaaagtcgactgcggccgcacactagcgccccgtgcggaccccacaaagttgaccgcggccgcatagccttcaccccgcactgcacaaggtcgaccgcggaccgcactggagggttcagagacctgcaacttctggttttaagcctaaaacatcctgaaactcacccaagccctcggaactcaaaaccaagtatgcatactacttaaaaacttcatatggacctattcgtgcgatcacatcattaaaataacatgtaaaatcatgaattaaacctcaaaacttaacattttcatcaagaacaatcaaagtccataactcttcaatcggaagtccaattcacgtcaattaaactccgtttttcaccaaatttcatggaaacgtcttaagtcatatataagacctataccgggcaccagaaccaaaatacgagccccccgaaaccatcatgttccaagcaaatttcatttcaattttccttaaacagttttagaaaacaatttcttttaaaaattcatttctcgggcttgggacctcggaattcgatttcgggcttacgcccatgtcccatattttcctacgaaccctccggaccgtcaaattatgggtccgggtctgtttacccaaaacgttgaccgaagtcaaattaactgattttataaccaatttttttatcatttttcaccgaatttcatatttaagcttttcggctacgcgcctggactgcacacacaaatcgaggtagctctaaatgaggttttcaaggccttagaacatagaatttaatttaaagcaagtaaaaggtcatcacattctccacctctaaaacaaccgttcgtcctcgaacgaacagaagaaggaagtacctaagtcagggaaaagatggggataaaggcttcgcatatcaaactcggactcccaggtcgatgcctcaggaggatgacctctccactgaacatgaacagaagaaaaaaattttgacctcaactgacgaagttgtcggtttagaatgactaccggctcttcctcataaaacaagtccttgtccaactagacagtgctgaaatataacacgtgggatggatcgccatgatacttccgaagcatggacacatgaaacactggatgcacggctgataagctcagcggcaatgcaagtctataagccacctctcccactcgatcaagaatctcaaatggaccaatgaacctagggctaagcttgcccttcttcccaaatctcatcatgcccttcataggcgacactcggagcaatacctgctcaccgaccataaaagccacatctcgaaccttgcggtctgcataacttttttgcctggactgagctgtacaaagcctatcttgaataatcttgaccgtatccaaggcctcctgaaccagatctgcacccaacaaccgagcctcccccggctcaaaccatccaaccggagatctatatcgcctaccatataaagcctcataaggagccatctggatactcgactagtagttgttgttgtaggcaaactctgctaaatgcaagaactgatcccacaaacctccaaaatcattgacgcaggcttggagcatatcctccaaaatctgaatagtccgctcggactgcccgttcatctgaggatgaaatgatgtactcaactcaacctgagtgcccaactcttattgaactgctcttcagaaacgtgaggtaaactgcgtaccttgatccaaaatgatagacacagtcacaccatgaagatgaacaatctcttagatgtagatctcagataacctctcggatgaataggagactgccacaagaatgaaatgcgctaacatggtcagcctatcaacaatgacccatactgcgtcgaacttcttctgagtctgcgggagtccaacaacaaaatccatagtaacccgctcccacttccactcgggaagctcaatcctctgaaataaaccaccaggcctctgatgctcatacttaacctgctgacaattcaaacaccgagccacatatgcaatgatgtccttcttcattctacgccaccaataatgctgtcgcaaatcctaatacatctctgcggcgcccgtatgaatagagtaccgtgagttgtggtcctcctctaaaatcaactcttggagcccatctacattaggcacacaaactcgaccctgcaatctcaaaactccatcatcacctaaggtaacctgcttggcacctcagtgttgcaccgtgtctctaaggacacacaaatggggatcatcatactgccaatcacggatacgctccaataatgaagaacgagcaaccgtgcacgctaacaccagactaggctcagaaacatccaacctcacgaactgattggccaaagcctgaacatccaatgtaagcagtctctcaccgaccagaatataagcaagactgcccatactgactgatttcctactcaaggcaatggccaccacattggcctttcccgggtgatataaaatagtgatatcataatccttcaacaactccaaccacctcctctaccgcaaattcaactccttttgatttaacaaatactgaagactcttgtgatccatgaacacctcacatgccacgccatatagataatgcctccaaatcttcaatgcgtgaacaatggctgccaactccaaatcatgaaccggatagttcttctcatgaatcttcaactgccacgaagcataggcaatgaccttgccatcctacattaacactgcaccaagaccaatacgagaagcatcacaataaactgtactaggcctaaacttatgggcaaaaccaacaccggtgtcgtagttagagctgtcttgagcttctggaagctcgcctcacactcgtgtgaccatttgaactgggcacccttctgggtcaacctggtcatcggggctgcgatagatgaaaaccccttcacgaaccggcgatagtagcctaccaatcccaagaaactccgaatctctgtagttgatgttggtctaggccagttcttgactgcctcagtcttcttcggatctacctgaatactctttgctaatacaacatgacccaggaatgcaactaaacgcagctagaactcacacttcgagaacttagcatatagcttactatccttcagagtctgaagaaccactctaagatgttgctcgtgctcctcccagctgcgggaatatatcaaaatatcatcaaagaagactatcacgaatgaatccaaataaggtctaaacactcggttcatcaaatccataaaatttgttggggcatttgtaaacccgaacgacataaccaagaactaataatgcccgtaccgagtgcgaagagctgtcttagggacatcggtgccctaatcctcaactgatggtagccagatctcaagtcaatctttgaaaataacttggcaccccaaagctgatcaaacaaatcatcaatccccgacaatggatacttattcttgatcgtaaccttgttcaactttcggtaatcaatacacatcctcatcgatccgtctattttcttgacaaacaacaccggcgcacgccacggcgaaatgctaggtctaatgaaacccttctcaagcaagtcttgcaattattccttcaactctttcaactcaggtgaggccatacgatacgacgggatagaaataggttgagtgcccaaatccaaattaatacgaaaatcaatatccttgtcgggtggcatacctggcatgtctaaagggaatacctcaggaaactaacgaacaatgggcacagaatcaatagagggaacctccacgctagaatcacgaacatatgccaaataagccaaacaccccttctcgaccatgcgttgagccttcacataagagataacactacgagtagaatgactaggattccctctccactctaaacgagggatatccggtaaggctaaggtcacagtcttggcatgacagtccaagatagcgtggtaaggcgataaccagtccatccccaatataacatcgaaatcgaccatgtctaaaagcaacaaatctacacgagtctcaagacccccaatcaccacaatacaagaacgatggactcgattaactacaatagagttacccaccggtgtagacacataaatgggaacactcaatgaatcactaggcataaccagatacgatgcaaaataagatggcatgcacgagtaggtggaccctggatcaaataacactgaagcatctttatcacaaactagaattgtacctgtgataattgcatctgaagcctcagcctagggcctggctggaatagcataacatcggggttgggccccaccatcctaggctccatccctgggatagcctacagctggctggactccacctctagcggcttgagctccacctctaaatcctctacctccacctctagaacctctacccccacctctagctggctaggtggtctgtggaacacctggtgcctggaccatagaacggggaccctgctgctacaacttagtacccaccaaccttggacaagtcctcctaatatgaccatactcaccaaaacatccacctgagtgttgtggatgaggaaactgtgattgtaggcgacccgaatgaccaccccaaaaactctggagcggtggtgcactgataggagccaatggtgcactataggactgctgatcggaatactgcatctacggaccacagctacatgaagcatcgtgagagacctgaagagctgactgaaagggcctgggaggatggcctatatcatatgaatctctgcctccagacgaggcaccactgaatctacctgaatgacggcgcctcttatccaacccatgaccacctccctatgacaggaccatctccactctacgggccacattggccgcctccttaaaagtgatctcactcccagcctccctaaccatctgaaggcgaatcggctgaataagaccatcaataaacctccttaccctctctctcggtaggaagtatgacaagagcatggcgagctaagtcgatgaacctggtctcatactgggtaactatgacgaaaccctactggaaaatctcaaactgccacgggtaggcctctctcttaatcattgggagaaacttctccagaaacaacactgtaaaccgctcccaagtcaaatatggcgatccggctggcttggccaagcaataatatctccaccaagtcttggcggatccagacaagcgaaatgtagcaaaatcgaccccattggtctcaacaataccaatgttcctaagaacctcgtgacagctatctaaataatcctagggatcctcagaagatgcaccgctgaaagtagaagtgaagagcttggtgaaccgatctagcctccacaaagcatcagtagacatagttgttccatcgcagatctgagctaccacacccggctgtacttctccaactggatgaatcactggagtctgaatctgaggagctacctgctctagagtatgagtagcaggagtccgggcccctcctccagcctgagagacggccggtgctacaggaagcaatcctgcccgggtgacactctccatgaggcccactaatcggacaagagcatcctgaaggactgggatagcaataaacccctctgggacctgagctgagcccacaggagctgttggggctggaacctcatcatcaaagtcaacctgaggctctgctactggggctactgctcggggctaagctctacccctacctcggcctctagcacggccttggcctcgccctctgatcctcgtgggagacgatgttgggggctcgggctgatgagcggtagatgaggaagcgtgtgttctcgccatttgcgaaaaaatagagtagaaattcaattagcatagagaaactgaaccgcacgacatgaaagaacaaatgtgaagtttttcctaactctgcagcctctaggggataaatacagacgtccctgtacctatccctcagactctacagagcttgtccgtgaatattgagacctatgtaacctaggtctctaataccaacttgtcacgacccagaattcccaccctcgggagtcgtgatggcgcctactcatagaagctaggcaagccacgaacttagaaatctttaacccttctgttttaatcatttttacaacatatattaacaagtgataagcatctaaatgacagcggaatatgatatgtaagcggaagttttaaatgaatataaaaccaaaatgtttcgaaagtcaacacattcctctacccagaaactggtgtcacaatatccacagactactaagagtactacatacaacagtttgaaggaaaaataacattgtttgtctcggatacatgagataatagaacataataaaagatagaggagacgccgagcctgcggacacctgcaggactacctcggaatctctgtggactgaaggctggctcccaagctactgatccaatgctgctccggtatctgcacagagtgtagagtgtagtatcagcacaactgaccccatgtgttggtaagtgcctggcctaaccccggcgaggtagtgacgaggctaggaccagactccagataaacctgtgcagctatataatgtataccgaaaaataaataggaataaatagtttaaaatgggaggggtacatgcttcgggaaagcatatcaagaccaacggaaactcaataaaatatgaaaggacaactcaatatctacaacaatacaataacaatactgtttcggtgcgcaacccgatcccttatcatttaacattgttgcggcgtgcaacccgatccacatatatatagctgttgcggcgtgcaacccgatccaatataatatatgttgcgacgtgcaacccgatccaatataatatctgttgcggcgtgcaacccaatatctgttgccgcgtacaacccgatccaatataatatctgttgtggcgtgcaacccgttccaactatacagtcaacaaaaaccataattaactgtcccgacaagggatcaacaatagatacactctcccggcaaaggaacatagcagtacaagtatatacgtcccagaaagggagaatcagctataaccaatcttaacgcaactcttacttgtctcaattgccaccgtttctcaatcgcaagtagattccacgacaaacaaactaagtctttgctcaatatcaaggatttagtcactatttcaaccatattaacattcaagaatacaacaagtatcaatttaagactcacgatcatgcttgacaccaacgtatagataatcgtcaccgtgcctaaacgtcgtactcaacaagaagcaaattacaaataggactcaactcctaattcctcaagctagggctagaccaaacacttacgtcgatgccacgaacacaacgcaaggttcaattatagttttaccccttgatttcaccgccaattcgctcgtatctagtcacaaattatttaattacatcaataaacgctaaatgaatcaatttgaatacatgaaaatgagttttctaaagttttacccaaaaagtcaaaaatcgcccccgggccaacttggtcaaaactcaaggatcgaaccaaaatccgattacccattcctccacgaacccaaatatatgatttgttttaaaatcggacctcaaatctaggtccaaatccctaatttttgaaaaacctaggttctacccaaaacacccaattttcccccatgaaaatcattgatttgaagttgaagtcatgttaaaagatattaatgattgaagaaaactagttaaaaatgacttacatttgatttggagaagaaaggttgtttgaaaaattgcctcttatgtttttggggttttgaaaaatgactgaaaatcccgtctatttatacccctctcagaccccatgtgtggaccgcacgaagtcgactgcggccgcagagtagcgccctgtccagaccgcacaaggttgactacggtcgcacagcagcgccctgtgcggaacgcacaaagtcgaccgcggccgcacagtcttcaccgcgcaccgcaaaaggtcgaccgcgaaccgcattggagggttcagagacctgcaacttctcgttttaagcctaaaacatccagaaacctacccgaaacacacccaaaccctcgaaactccaaaccaagtgtacatactactcaaaaacttcatatggacctattcgtgcgatcacatcatcaaaataacatgtaaaatcatgaattaaacctcaaaacttaacgttttcatcaagaactctcaaagtccataactcctcaaccggaagtccaattcacgtcaattaaactccatttttcaccaaatttcacgaaaacaacttaattcatatataagacctgtaccgggcaccagaaccgaaataagggcccgataccatcatgttccaagcaaatttcatttcaattttccttaaatagtttcagaaaacaatttcttttaaaaatttatttctcgggcttgggaccttggaattcgattccgagcatacgcccaagtctcatatttttctacgaaccctccgggaccgtcaaatcatgggtccgggtccatttatccaaaatattgaccgaagtcaaattaactcattttataaccaattattatcatttttcacggaatttcatatttaagctttccggctatgtgcccggattgtgcacgcaaatcgatgtggctctaaatgaggttttcaaggccttagaacacagaatttaatttaaatcaagtgatgacctcatcacaatgtcattaaaaaggacaaatggtggagcagcaaaatacaaagcatattggcatggactgggtataaatccggtaaggggcttgggaagaatctccagggtattactaagccaatacagctgaagcgtcatggtactaccttcgggctcggatatcagtatacatggtaagaatataatgattggtcgcctccatggtgtggaccttattaccctcttgagcaaccagcgccacatctagatcaagcttttcaccaagccgacacaatatggggaactgcagaagaggaagcattagctgggttgaggaatatgttcttggaggatgaggacatcgactgcagtgcaataattgaggaggaggaggaggaagaaggtctcactattcagactgtggagaagggagctgttctcaggaattggatcgtcacaccatcccgggcccgccgagtccctgggtagcttggaagatttcattcctatagctattctaggcatttaatatttttccataatttgtttttaagatacacttgtttcaaaataaatgctcgattcatcgagccgtacccgtttagatgttttaagtattaataaaatgcattactctttattatttattgttatctttcatatttttctttctacagcgttattgttacttttcctgatgaaccggtgactgtgacatgtaacgaggcaacgcaacatgagaatagtggttcagatgaagaagatgagatccttgaggaagttgtaagggaagttgaaaattttgagaataaacctaagtccaacctggacgagaccgaagcagtaaatttgggggacgccgagatcgttaaggaaactcgcatcagtattcatttatcgccgatagagaaagaggagtacatctgctttctaaaggaatatgaggacattttcgcatggtcatatgataacatgactggtttgagcacgtccatagtggctcacaagttgcctactaaccctatgtgtgtgtcggtaaagcagaaacttagaaaatttgaaccagatatgatcctgaaaatcaaggaggaagttactaagcaaatcaaagccaaagttctcagggttgttaagtacccaacctagttagctaatattgtgcagtacaaagaaagatggaaagtcaaagtatgtgttgactatcaggatttaaacagagcaagtcccatagaaaatttcccactgccaaacatacacatcatgatcaataattgcgccaaacataaactctaatcttttgtagattgcttcacgggttatcaccagatctggatggatgaagaagacgcagataaaacaacatttattacaccatggagggtatactgctataagatgatgccatttggtttaaagagtgctggagctacctacatgagggtcatgacaaccatcttctatgatatgatacacaaagaaatagaggtgtctatggacgacgttattatcaaatccaagagtgtcgcggatcacatagcaaatttgagaaagttctttgataggttaaggaggtaaatttgaagctgaatcctccaaagtgtgcatttggggttcccgcaggaaagttattaggattcatcgtcagccgtcgagggatcgagttagatccatctaaagtcaaggttattcaggagttaccaccacctaggagcaaaaaggacgtgatgagcttcctaggatatctcaactatatcagtcgcttcatagcacagtccacagccatatgtgaacccatcttcaagatgctgaggaaagatgctgatacaagctggaccgagtattgtcagaaagcttttgacaaagtcaaggagtacatgtccacaccaccagttctactcccatcggaaccaggacggccttttatactttatctatctatattagagggagccttcggatgtgttctaggacaacatgatgagacaggaagaaaagagcaagccatatattacttgagttagaagttcactccttacgaagcacggtactctttgctagagcgcacttgatgtgctttgacctggatagcccagaagttgagacattacttctatgcctataccacatacctcatatccaagatggaccctttgaattacatatttcagaaactcatgccaacttgaaagttagccaaatggaagatactgttaagtgagtttgatatcgtctacgtaactcaaaaggaggtcaaaggacaagcattggcagatcatcttgctaaaaattcggtgggaggagaatatgagcccttgaaaatgtattttcctgataaagaggtgtcattcgtaggagaggactttaccgaagaatacggcggttggaggatgttctttgacggagctacaaatttcaaaggagtggtctttggagcagttttggaatcagaaacaggtcaacattatccggtatctgctaaaatcagattcccctgcaccaacaacatggcataatatgaagcctgcatactaggactcaacatggcaatattcaggagctattggtaatcggtgattcagattttcttgtgcaccaggtacaaggagaatgggccaccaaaaattcaaagatattgccatatctgcaccatgtgcaagaattgagaaagaggttcacgaagatagagttctgacatgtgcccagaattcagaatgagtttgtcgatgcattggccactttatcatccatgatacagcacccgaacaagaattacattaatcctatcccagtgagaattcataatcagcatgtatattgtgctcatgtcgaagaagaaacagctggaaaaccttggttccatgacatcaaggaatatttggcgaaaggagaatatccagagcatgcaaaccccactcagaaacgcacactccggaggttgtccaatcacttcttccacagcggaggaaatttgtatagaagaactcctaatttggtactgctaagatgtgtcgacacaaaagaggcttctaagctacttgaggagatacgtgctgggacctgcagccgacatatgaatggttttgtcttaaccaagaagatactcagggccggttacttttggatgaccatggagacagattgcgtccaatatgtccgcaaatgataccagtgccaagtgcatgacgatatgataaaagtaccgccaaatgagctcaacgcaacaagctaaccttggccatttgtcacctagggaatggatgtcatcggtctgatcgagcccactatttcaaacgaacacaggtttattctagtagccattgattacttcaagaaatgggtagaggctgcatcttacaaagttgtaaccaagaaagtcatcacagactttgtcaaagatcgtattgtttgccaattcggagttcccgagtctattgtcactgataatgacgccaatctcaatagttatctgatgaaagccatgtgtgaaactttcaaaatcaaggacaagaattccatagactataaaccttagaggaatggatccatagaagctgccaacaaaaacatcaagaaaataataaggaagatggtagaaaaccacaaacaatggcacgaaaagcttcctttttctctgttgagataccgcactatagtgcgcccatcaaccagagcaactccttacatgttggtttatggtatcgaggcggtcatcccaaccgaggtagagattaattctttaagaataatacacgaagctgaactcagcgatgcagaatggataaggagccgctatgaacaattggctctcatagatggaaaaacgataaacgcagtatgtcacggtcaactttatcagaacagaatgtctagaactttcaataaaagggtcaaaccaagacaatctgcaccaggatagctagtgttgaagaagattttcccacaccaagctgaggccaaagagaaattctctcccaactggcaaggtccgtacatggttcacagggtgctaaggggaggagcactcatactcgcagagatggatagagaaatctggccaaaaccaatcaatttagaagcagtcaagagatactatgcttagactatttacatttcctcatttgatgtaattgaactacgcttgacttgattcccatttaagaggggatacgtaggcagccttatgggttcagtcatatcataataaaatttccattttttccaaagttagaaactggggcagaattttgaggaggaccctcaaaatttcggagcaagtccagccaacgccaacatatgttagacggtcagaaataggttaaaaattggggcagaattttgagaaggattctcaaaattccgaagaatgttcgttaaggctcattacccgcaaacagccaaaggatcatctaccaaactgggacagaattttgaggaggaccctcaaaattctaatatgagaaagatgcaatgtctctgaaatgtgttatagtcactagttcatctaaaaatcatttcatatatcaatatgtttctaaaatgacactatttttatcaataattgcatattttcgaaaactctatttccgtgatagccaggtgttacccagggaaattcgaaaaggcctctagaacggataaagcaaggcccgtagacagaagcatgaaccaagctcccccttacaaaactcataatttttctttgaacacaagcacacttgatgtaacgatagcatccgcaaacatgtatacacaaagcaaaatcactatcaaacaggccatcagacactgaatatatctccagctaagaaacctactactcttatttgttactcgctctttgcatgggactaagccttgtcccgcatatttgcatgaggctaattcatgcctccatattcgcataaggctaatccctgcttccatatctgcatgaggctaatccatgcctccatatttgcatgaggctaatctctgcttccctgtctgcatgaggctaatccttgcctctatatctgcatgaggctaatccctgcctccctgtctgcatgaggctaatccctgcctccctgtctgcatgaggctaatccctgcctccctgtctgcatgaggctaatccttgcctctatatctgcatgagactaatccttgcctccatatttgcataaggttaatccttgcctccatatctgcatgaggctaatcattgcctccatacttgcatgaggctaattcttgcctccttatttgcatgaggctaatccctgcctccatatttgcatgaggctaatccctacctccctacctgcatgaggctaatccttgcctccatatctgcatgaggctaatccctgcctccatattttcatgaggctaatccctgcctccctacctgcgtgaggctaatccatgccgccatatttgcatgaggctaatccttgcctctatacctgcatgaggctaatccctgcctccgcccctacatgaggctaatctctgcctccacatttgcatgggactaagcattgtccctccgtaaataagcattgctttattctagtactatctatttgcaatgggccaagctctgcccttcatttcacaagactaagccttgtcttggtaacaccatattaccgcatatcatgggctgaaatattgccaatctatccaaggacgtcatagtctaaaaggcatcatcctcatagccggaagacactatgccatggcttgaggatccctcaaacttgaatattattattcaaaggcgtcatggttcgaagacaccatatgcatgacccgagaacactatttcatgacatgcgaattcctcactaaacaattcatggcccaggacatcatagtccgaggacgtcatccttaaccgtccaaagacaactttcatggtccaaagggaatctgcatcatgtttaaatttctgcacaaatacatgcttgtagcatctctttatcagcaggtaacctgcaagcaaccgctatcctagcaagatcgacctcgctccagttccttcaactatctcaaaccttagccattcgtcataactgccttgcatctcgtgtccgttcttgtagtgacttcatcggcatattccaccaatgaatccagaactacatgtggcctgatttctataaaactagggatatgtaggcatctcaaagaccagagtacgacctctatccttcaaaacatcccatccggtcaaaattgaccatcatttctttacccgaaaactctttcatccttcccgggtaaagaggggcaactgttgatacccaatttttcctcacatattttgaacatatatatactttaaaaatatcacatatacaactataagactacataagtattttttttatataatttttccataattgtaaaagctccaaatcgatttatttcttctctttttattacataaatatccaataattatccttcgtactacttttgtaataatttagccatttaaattcattatttatgccaacatagtgtttaaatatttttagtgcattttttataattgcatttatattgtttaggccaaattgcacatctttgcaataatagcccatactaatgtattattatattatttatgcataaaatggccttatatatttttaaaatgttaaataactattttaaatcattttattacacaatatattttttatattcatttattatttttataaattatttagttattaaaattagttatttaaaatttggccctattttctatttcaattctgatccaaatttgacctaatacccagtgcccaatttcaacctaaacctacccaggcccaatactcatctgccccaacccaatacccggccaaatcctggttgttgatcgttttgatcaacagtccaggtttcccccttcctatattaaacctaatgaaccttccccaaaaccctctcatttccctcaccttccccgccattacctaatcctctcatctctcaaattctctcaaacctaaccctagtcggacctcgccgtcgctcatttatgggtaactagggtggtttctcaccacccccaggcctctaatggcctctctctcgtactggtctcaccatctccagggtcctcaagggaccaaggttagtctccttgcatctatggtcctttctcgcctgtttcaggctgttctgatgtgatttcgagtaagagcttcctatattgccttagatctatgggtttctgagtttacttcttcacctctaagttgttctcctcgaaaccctaatttcttctaaacttcttagatctgtacagatctgagatgtttggacctatttcatatgatttatttacaaaaaaccttttgatttttacaaggatcttctgattttcaaatggttttccattttcctaaactagggtttcccgaaaaatttcttttccaaaaatgtttgatagttttgagtgtttgaacttctgtttcctatatgttttaactaatttcataaggttgctctaaccttaactcgtttatactaaaagccctaactttttagacattctttgtttggtttctgagtacttgtgtactgactttgctcttgccttggttcttttgatttttctttagccatttagatgtctcttggttttcttatcctaatatgcctctaccgagtttcttaattcaacttccctattgattctatatgtttatgttcattctgactattcatgttaagactatatttttctccttaaatcagtatcgttttcttgatttaccaatttgtttcattaaagttatgtgtcgaatcctgactattcatttcttgtcttattttatctgcgagacttgctgactctttacgtgattttctctttaattgaacccttgactattctgaagttcttatttcctggtttgatttgaactcttttctttaacaaaacttttttattctgatttctctacttggtttgattgaactccttgccttaattattttttcccttgccttatttgttatttgctgattcttattgtttgtttccttaattgaaacttctgttcatttacccctaattacctactctatacccaaaccttacttgatttttcttccttaaatacctatcatgcttttatcgttgatttgattatcccatgattaagcagaagacttactgattttacgtatgactgattctgtgaatttccctaattgctacataattgatccctttgccttattttgtttaactcttgattactatataaactccttcttattttaactactggacacaaacaattgttcagaaactatcactttacactttaaaaagctctctctcagctatctttgctctctttgctacttgtaatccctgttattctagttggatgcaagccaaggctgggaattgtacaataccttactcacatcttgtattttctttctttaactaggtatgcttctgattaatttttaagaatctaaacctatgtgtttatttactattttagttcatatggcctgagtccattcttgtttctgtttactgcttacccagcacgcccaatattgcatattcaaacctgtgattagtatgtttccattttacctacttgtttgctatcttgtttaacatgtatacatatgtaactaagttgtttgatgaaatactatttatcttgcatgcctaaactctacttctatgtaactagcatgccttcacttgttaatacctatccagcatgctcatttaaaaccttacatgttatgtccccctcctgctaagttagttaatctccttagagtgattctagctgtgttgatatcctcaacatgtttctgctgtgatccttgatgcttgacttgtattctatctaacctactagttctatagaacccttcaaaagctctatgtatcctgttgattgtgtgctccattaaggtgtcctctctatgttcctaacccctcttcccttgtgtgaaagtcgtttgccaaagtacttcctaaaaactattggttttatgacttgtgtcttgatttcaaattgtttctttacacttcctcaaactgttttatcactaaatcagcactagttttcagaaattcttttaaatcctaagatctttctttaaactatctattaaactctttcaaaccattatgcacttccacttactcttagaaaactaggttttgcccctctgatatgtgtgctggcttgagactcttgagatctctctaaacttgggcatgttagggctggcacttccatactgcacctaaatcagttattatttgagaaaagtctaggtgtgagcactgcccaggatccttgaggttcttagggaactctgacacacctagacatgaaattggctataaaactttgggtatttgagactactggaggcttggaaatcactttggtcctacttcaggctccctatagattaatttctgttagaaatatgtaatttttcttttattcaattcattggtctataataattattgtaaacaaacagttgtgtgattagtgaaaaagggagggtagttgtacattgagggtaaaattgggtagataccatgcctatagggtccatgttgattccaatgtgtttaattagaaatcatgcctataggatttaaaccagtttagttagaaaatcagcttagttcatgtttattctgaatcggtttagttaactaatttgtctgctcctttaacaagttttcaatgctatcttaattaatattactagagaacatgcctataggatctaaactgtcgttttaaaagaaaaattgtttgctgtttcattgcattcttagtcaataatagataccatgcttctaagatatctccattatgcgtctaggcaatcctgtagggtgactaaaaccctgtaaactataaaactgcgtctttttatttgagacttctcacattcaagaggtttaaaagaatcagtaggcaagtagaattcagttctttgacactttggtcctaattcaatattgtatgctctctgctcacctagatatcatgttctaagattttctttgaaatacctgaaactgttgtttgagacgtgcacttacttgttatgtttgtggaggtaaatatgagcctttaattgttccctctttaagtgcagtcctaattgttttgattgacgcttagacttttcttctttaaataccttagtatggtctagaaccacctaaattagaggtcctaaatacctccagggccacaagaaagggacgggtagtgcacgtataggatatctttcaaggttgctagaacgctttagggtatgactaaagggagggaattggttagtaagaatatgatgactacgcactaatgtcacgtgtagccccttattgaggagtgattaccgggcattgtgtgggtatgatcctataggctaaccaacctaggacccctctttcccaactcctgttgtttaaataaatttacttttctttataaatgtgcaacttgttcaagccttttcctttgtttcattacttgaatcatacatgtgcttagaatgtcaaaacatgtctttacttgcaagtacgtgttaaaactgtttatttattaaaatgactaattcacatagtttaagttcggtcgggacccaccgttgtggaccgtgaggggtgcctagcaccttcccttcaaggttattttgagcccttaccctaaatctttggtaatacaaactagtccatgagttaattgctcaaggtgccctaatgcaccataatccgttaggtggcgactcttcgaatacccaattcccaaaagaaaacgagttatttcccccatgaatgtcgaaacctagacttccccgtcaaaaagaagaaaaaaaagggcgcgacagtgatcacatcatcgcagaagattatgaactatgggacattgttactgatggtctattggctaccatgaagaaaaatgttgaaggagtggatgtatcaaagactagagctgactgcaatgctaaggacttgaagaggtgggaaaagagttctaaggccaagaaatggcttgtgtgtggacttggtccagacgagtacagcagaattcaaagatgtactactgctaaggaaatttgggacactttgcaagtggctcacgaaggaactcctcaagtgaagagatcatgaggaacactgttgtattctcaatatgagaatttcaccatgaaggaaggagaaaccatccaagagatgtatacaaggttcacaacactaacaaatgaacttaagtctcttggaaggattatccttaacgaatacaaggttgagaaaattctaacaagggttttgccagttacttgggaaagcaaaatcgctgttattcaggaatcaaagaacattgccactctcaagttggacgagttaattggaaatctcactgcctatgaacttataaggcaaaccatgaagatggatgcacccaagaaggaaagaagcttagctctcagagttgctgaaggtgcagatctagaggaggatgaaatgtctatgatcacgagggatttcaagaagtatttaatgagagaaaagggttcttcaagaggtgcaacttacaataaaccaagggtccctgagaaatagaccaacgagggttgttacaaatgtggtaagactgaccacatgatcaaaaactatcctcaatgggaaattgaatggaagaaagaaagggctgaacgaagaaacaggaagaaggaacaggttcatcccatgaagaacaaaggatcaacaaaggctatggttgttgctcgaggagaaagctcggatgaggattcagaagatgaagatagaaatgaacaagtaattatggccattagagaatcagatgatgaactagaggtaaatgtgattcatctcaaagacaagatttaaatttttgtctaaagaaaggctatcggagttactgctagatttcattgatgaatctgaggtcataaacaataaaaaggaacagctgtctaaggaatgtgtaatcttgaaatctaagtgcaaaaatctagaacttagggctagtgaaagtgatagtaaaaatgccgagttgaagaacctggttcttgaacttgacaccactattttagaacttatatctaaaaatttaaaatcgaaattaggaactggtaaaaagaaagctgaccacatacatctcaccttagaataaaatctagaaaaaataaaggatgagttgtacaaaaaggatgagcggataaaagtcctaaaagaatatctaagcaaggttaagcatgaactagatagaacttgcaaatggaataagtcctctgatgcactatcatggctacaaaaacatcacagtagcaataagagaggacttggctatgagacccatgcacctaagtgggatcccaaaagcaagaacatcactaagaacaaaatctgcacacactgtagtaagaccggtcactacaaaagtgaatgtaatacaaaagaaaaggccagtcaaaagaacaaaacctttgttctagggaaaaataggctgccaggatgggctaaaaagaatttaattcacccttttgcatatagaaagggacccaaactagtttgtattcctaagactaacccctgatttccttttgcaggtccaagtgaaggggagaagccaaatacggtacatggatagtggttgctcaaagcatatgactggaagaaagaaccagttccattgagaatgtctgttgatagatggcttgaaatatagcctaatcagtgtatcacaaatgtgttacagaggtaacttagtagcattcacctctaccaaatattttgtgataaatattaccacggacaagattattttgcaggaaaaaagagtaaataatatatacattatagatctgcccactctttcagaaaatgaactcacttacttaagtgtgttggacaatgatcccctgctttggcacaaaagacttggacatgcaagtctaagtcaactcaacaaattagtctccaaggacctggtgatagggcttcctaacatcaagttcaaggaagacagtttgtgaggcttgtgcaagggggaagaaggtaagatcctcttttaaaagcaagaaaatggtaagcacaaccaggtcgatggaactagttcatatggatctctgtggtccaatgagaacattaagcagaggtgttaaaaaatatgtgatggtacttgttgatgattactctaagtttacttgaacattatttttaacatctaagtatgaagcatttgacatgtttactgcctttgttagaaaaacttagaaacaactaggtaatcaacttgcatcaattaggtctaatcatgaaactgaatttgaaaatgctaagtttgctgaattttgtgatgagcattctgcctctaggactccacaacaaaatggagtagttgaaagaaaggataggacacttgaagatatggctaggactatgcttttttctagtaaactgccacatagcttctaggcagaagctgtaaacacttcatgttacatcattaataggtgcttgaccagacctcttgtagagaagactctctatgagttacttaaagggagaaaaccaaatatatcctatcttagggcatttggatgcaagtgctttgtgcacaacaatggaaaggacttcctatgtaagtttgatcccataagtgatggagtattcttgggatatttttcacatagaaaagcttataaagtatacaacaaaagaactatgtatgtagaagaaagtttacatgtagtctttgatgaaactaacactctttctgagagacaggaacataaagatgaagctattgggctggtaaaaggtttaaatggagtcacagtccaagctgaagctgcaccagaagaaggaacaggtgatggaataggttcttccgtctagggcaacctgacagggggaaccgaataaataagaactgaatctaatgcccaaatggaacctatccatgaggttgttcctcagcaacagaacataggagaaatgtcaaacagaaaccagttggttgtgaaaccttacaagtattaaagttctcatcccattgagaacataattactaaaccaacttcgggaattaaaactagatctgaattaaagaatatgtgtgcttttgatgctttcctatctcttattgaacctaaaaatgttgttgaggctttgcaggatgcagactggataaatgcaatgcaagatgaactcaatcagtctgaaaggagtcaagtttggcatctggttccaacccaaggacagatcagtaattggtacaaaatgggtcttcagaaacaaacttgatgaagatggaactattacaaggaacaagtcaaggttatccaggaggaaggcatagactatgatgagacctttgctccagttgcaaggttggaagcaataagactcctcatagcatttgctgtatatatggaatttactcttcaccagatggacgtcaagagtgcctttataaatggctacttaaaggaagaagtgtttgtcaaacaacctgtagggtttgaaagcaaggagtgcccggatcatgtatacaaactagacaaggcactctatggactcaagcaggctcctagagcatagtatgaacgactatccaaattcctgcttgaacatggctacaagagaggtaaaattgatagcactttattcttgaggaaaaaggtaaggatcttcttgtagtataaatatatgttgatgacataattttttgggcaaccattgaaaaactaagtaaggaatttgctaaacttatggggagtgaatttgaaatgagtatgatgggtgagcttaatttcttcttaggcttacaaattaaacaaaactcaaatagaaccatgatccatcagtagaaatatgcaaaagagttgattaagaaatttaaaatggaagaatcaaaggaaatagacacttatattgcaacagccacaaaattggacatagatgaacctgattcatctgttgatcagaagttgtataggggtatgattggttcatttttgtatcttactgctagaatacctgacattatattcagtgtagggctttgtgctcgatttcgagcaaatccaaaggaatcccacttgactgctgtcaagagaatattgagatacttgaaaggcattactgacctttgtctttgttatccaaaaggtagtaactttaacctagtgggatatgttgatgttgactatacaagttttcttgtggataggaagagcacctcaggtatggcacacttcctcggttcatgtcttgtgtcatgggctactaaaaagcaaaattcagtggccttatccactgctgaagctgagtaagttgttgctgcttcctgttgtgctcaattgttgtggatcaaacagcagttgatggattttggtattgaagttggttgcatccctattttctgtgataacactagtgttcatcataagagaattaagcacatagatgttaggcaccatttcttgagggacaactatgagaaaggcttgatcactatggaattttatgctactgacaagcaaattgctgacagttccaagtacctgtcttttatttctagttcaattatagtaggtgtttttatattgtacctttcaacttatctagaagcaattgtattaggtactcaaagttttcaagttagagttaacgtgaagttgtcgcaacagttcaggtagtgtgctacaacgggattagagttaatcctaggtttacaaaagagtttttgtaaatgtagtttttggctcagtgattttagtggagagtttgggaaaattctactggaaagtaggtcgtattttttctccttttgagccaggtatttttcacgtaaaatctctgtgttctttaatttctgtactcattattctgcaactgtagtagttggaacgcgtagaagaaccaggtccttccataatcagtttaagcgaaaaattggtcaccacataaatcacccctccccctcttgtgtggtattgaaatataaaacatcacttccctttaacctcgattttttattttacttgagctcgatttttcccgcgttcggtcatgcccgattcttggcgtgtccttcatccctccgagttctgatctgtaggaggccttggcttttacccgacctagtatcgaaccatgttatctctcgtatcttcatcaaaatcgggagtaattttatgtccgattttatcggtacacaactttcttcaactaaaactgaggaaacaaaaaagacagaagtagccaccactctgtgggtactatcttcacgtttctgagaatgtattggacctttatttcttaaaatagaaatatagtacactcttttcttgcatttgacagatcatgttattactagatacaaaagtacacatatgctaggcgtgtcctttatatagattaaatataattccgttaacaaaggatctcaaatgactgaaattttcagaaatgaacgtgactgcagttcattgatctacattttaacggataaactgttaacccgttaaaatattttatatttgtatttttttacacctattgtatattaaatatccttttcactatttgacaaagtagcagttatgattcgcgttcagaaggtatagtaagacactaactgttatgttttatcttagatgctaacttagtggtattagactattgaaaattcactttcaaattccaatgacctctgtcggttagtgaaaatgtacttgcatatggctatatgacttgatgcaatagcagaaagaaaagagccatacacaacattaatttagtatatggctattacataaatttagtcagtgacttctggaaatagtttgaatattcgggcatgacagtgtcatataaacgggttgaattcaacatttaaatttagtgatttaatgtcaagagatatatgtactcattatctatttgatttagccgataaatcacccgataaccgtccgataattgttaaaccgatacaaattcgatgttgcggaagccaaatatatatagtgtgaataagtcacaactactataccaaaaattgtgacagccaccaaataataaataagacaataaagcaacaataaagggaacaccagaatttacgaggttcggctaattttgcctactcctcggacacaaccaatattttattccactccaaaaatacaagtgaaataatattaaagagagaagatacaaatgtcttaaacagatgagaaggcaaatgagaggtgtgtttaaatcctaaacattagaccttcttttataggggaaaatcccctccaaactcaagagcccaccgatgtgggacaaagaatttgccaaacttcaacaaatctccaccttgaaaaaatttcacatcttcaattttctctcaataacaaatttcaaatttttgattgtgtctaaatcttcaatcttcagtgttcaacaatgttgatcaaatccaaacaatgttgaaacttgatcgcagtcaccaccttagtcagcatatcagcaggattctccgtggtatgaattttcttcaccgcgactcctccgtcttctatgatttctagtacgaaatgataccgaacatcaatatgcttcgtccttgcatgataaacttggttcttcgctaattgaatagcactttgactatcacaaaaaattgtgatacctttttgttcaacaccaagctcctttagcaatccttgaagccaaattgcctctttcacaacctctgtaatagccatgtactctgcctctgttgtagacaaagcaactgttgactgcaaagtagacttccaactaactggtgcctttgcaaaagtaaacacataaccagtagttgatcttcgtttgtccagatcacccgcaaaatctgagtcacaatatccaactacagactgattgtcttcctgctcaaaaactaacccaacgtctacaatattatgaatataccgtagaatccacttcacagcttgccaatgctccttccttggattgtgcatatatctgctaataactccaacagcttgtgaaatgtcaggccttgtgcaaaccattgcatacatcaagctaccaacagcatttgcgtatggtacctttgacatatactctcgttcagcttcatccattggcgacatagtagtacttagcttaaaatgggaagcaagtggagtactaactggcttagtcttgtcatctatgccaaaacgtttaagtactctcttcaaatattccttttgagataaacagagtttctttgaatgtctatctctaattatctccatgccaagaattttctttgcctcacccaaatccttcatctcgaactccttcttcagttgaatcttcaacttatcaatttcttccgaattcttggaagctatcaacatatcatcaacatataggagaagatataaaaaggaaccatctttaagcttgtgcaaatacacacaatgatcgtatttgcttctcttgtacccttgccgcaacataaactcgtcaaatcatttgtaccattgtctagaagattgtttcaatccgtacaacaatttttcaagttttcacaccatattttcttttccagaaactttgaatccttctggttgagtcatgtagatttcctcctccaagtttccatgtaaaaacgcaatttttacatccatctgaactagttccaaatccaattgtgctaccaaagccaacataattctaatggaggaatgttttagaactggagaaaacacttcattgtactcaattccctccttttgagcatatcctttgaccaccaatcttgctttgtagcgaacatctacttgcttaggaaatccttctttctttgcaaatactcatttgcacccaattgctttctttcccttcgagagattggccaatctccatgaatgattctgatgaagggactgtatttcatcattcatggtaatcctccacttatcttcttctgaactttggacagcgtctttataagtggtaggaacatcatcagctacaattgaggttgcacaagcaaccgtctctatgagacgaacaagtttcgttattgttctttttggcctgctggttgctattgattcaagttgttgttgaggttcctgagttggaatctcctctactggctctccttccagagggtaatcttaatttgtttcctcctctgcttcttgtataggaaaaataaatttttccctcaaactctacctgcttagaagcaccttcattttgtttggtatcttctgttaccttttttaccatagcagattcatcaaaggtaacatctctgctgaatattactttctttgtcataggacaccataagcgatatcctttgactccagaagcaattcccataaaaatagccttctttgcccttggatccaattttgactctgtcacataataatatgtagttgagccaaacacgtgcaaagagtcataatctacagcaggctttccataccatttttcaaatagtgtcttgccataaatagcagcagatggtagatgattaatgaggtggcatgcatatgtaattgcctcagcccaaaattcttttcccaagccagcattggacaacatataccgtaccttctccagcaaggtccggttcatacgttctgccactcaattctgttggggtatatgtctaacaataaagtgtcggacgatgccatcattttcatagaccttattgaaatgatcatttttgtattcacctccattgtctgtgcgaatacgcttgatcctcctgcctgtttgattctccaccatcgccttccatttgagaaaaattctcagcacttcatctttgcttttcattgtatacacccacactcttcgggaaaaatcgtcaacaaaggttacaaaatagtgcttcccacccaatgaaggtgttttggaaggaccccaaacatcagagtgtacataatccaaaatgcctttagtattatggatcgttgtaccaaatttaatccttgtctgtttccctttgacacaatgctcacaaaactccaagttgcaagcctttactccttttaacaatccttgatctgatagagttttcaaggattttcctccagcatgtcccaagcgcatgtgtcatagcttggttgcgtctgcctctttgtcgtcactggatgtcactgtcactgtcccaataactgtactgccacgatagcggtacatattattattcttccgattagccttcattaccactagtgcactggagcatactctcatcactccattttctgcaatgattttgaacccttttgattctagggctcctatagagatgagattcttcttcaaatccggtacaaatcgaacatctgttaatgttctgatcattccatcatggttccttaatcgtattgaaccaatgccatatgaggtaagagggctgttatccgctgtgtggatgactccatattctccttcttgaaattccacaaaccagtccttgttgggacacatatgatagctacaagccgagtccatcaaccatatgtctgatgatgtttatgactctgttgtaactaatgagaagtctgaatcatcacaatcagctacatttgaatccataatggcctttccattgttatgtttggccttattcttcaacttcggacagcctttcttcagtgccctttttctcgacaaaaggcacattcatctttgttgggtctggatcttgacttggatcttcccttctttgtcctcgtttgattttgaggacgaaccctcacaaatagtgcttctccttctccgtacttctatttttctcactttctttgttcatagctgtacaaagccgaacaaacttctctgagagaaacttcgtcatttccatggagtagagtagtttcaaggtgctcgtactcatcaggaagtgacgccaacaacatcaaggccaagtcaccatcatcataagttgtatccatattttgcaaatctgtgaccaacttattgaaactggtgatatgttcattcatcgtggtaccgggaacataggtgaagtgaaacagtctcttcttcatgtacaatttattttgactatttttcttcaaaaatttatcctccagtactttccataatttacttgcagaagtttcctttgtgtatggagatttctgctctctaacaaggaaggatcgaatggtaccgcaagcaacacggttgataatttttcaatcttcttctccaataacatctggtctcttttcttcaatggcaagatctagcccttgttgaaaaaggacatctagaacctcgccttgccacatcccaaaatgcccggacccgtcaaaaatttctaccgcaaatttcgcatttgacataattcttgtcataagcgaagatgtcaatgatgacgtatttttgacacttgatatagattcttcttgtttattgtctcccatatttgacacaaatattatttaatagctgacgacaaaaatcgagattatttcctttctgatgtagaagatcagactaagctgcaaccacagagcatactcagacagaaccttgactcagttaccaagataaatcttttctgatgtggaagatcagactatgctgcaaccacagagcatacttagacagtatcttggctctgataccaattgttgcggaagccaaatgtatatagtgtgaataagtcacaactactataccaaaaattatgacagccaccaaataataaataagacaataaagcaacaataaagggaacaccataatttacgaggttcggctaattttgcctactcctcggacacaaccaatattttattccactccaaaaatacaagtgaaataatactaaagagagaagatataaatgtcttaaacagatgagaaggcaaatgagaggtgtgtttaaatcctaaacattaggccttcttttataggggaaaatccccccaaactcaagagcccaccgatgtgggacaaagaatttgccaaacttcaacattcgcccgatatcttattggtttggctagcggattagtacatttacgagccgataaccgataagtcgaaccgttaaatgtaacaatgcgcctgatccgcccgataagcagtcgtaccaaaatctaatgaacccatagattatacattggataccaggcaatattctcatgaaagaaaaagaagaagaagaaaaaaaagctgctggacgacgacttgtaaatgctttctcttacgtgacctttcttttaacgagattaattagttgacagataaatcacttccaaaaatgtcgtttgttcttctgcttcccttgttcatataaagccttaacacttggaggggaaagatgaatgttttgtattagaaaagcattgatcattgtgctagtgtttagtttggtaaaaaaaaaaaaaaaaacatgtaacaaatgataatcgtacaaggagtagtatatggtataaggatcgtgcttcaataatattttgaatactaaagatcgagaagaatgtatagatgttgattgagctaagtgaaatgagttttttttattttaaaaatgaaaatagagggaaaatttccacacccatcaatgatgatccctttaggtgaaacgattaaaaaagatttcatcaacaagaacattttataaaatatttactcttatcaaacacaaataagtccctccatcttattttgtaggcatatttccttactagtttgttcctaaaaaattaatatattatcttaatgataaattttatagttaatcacacaaatattgttgtgtcatgtttaagccaaaaagttttagtcttatatccacaaataatactatgacatgtttataattgcaagtttcaaaaatattttttgtttttaaatttcgtgtgaagtctaacaatgcaaagcaaattgaaatagagggaatatattatttctcatttactatattttttttttttgcctccctcttcttatcaatcgagagcttcccacatgccaggcaccaaaaatctataagatcttccacattgtcataaagaaaatcattaattttatttggtgatatttcatttcccaaaaaacatatataaagagaagaatccaaagtaaaaaaagtagttaagcaatatttacctgtgtttatccttaaaataagtaacacaatcaaatttgtactcgatttaaagaaaaaataatttaatttaacacgaataatttaagaacaacaaataattaaattaaaagaaaacaaggcgaccaaaccaaatgtgataaaacaattaagctttgctttaagtttagatgctgaaaccagtctcgatcgagtcatcgaagtgggttcacttgatactaaataaataaatagctgaagaacactttaaacaataactagaaggcacagataaacttttattgctttgatatatgtgttcacagtgcctttaaaagcaaaaggttctctcatttatatagcaagatagtttcaattctagtacaagtctaaataaggtaaaaattcttttttcctagtaaaacataatttgtcgttgatatctggcgtgatccgcgccgtaatattcgattgatggcagatatttcggcccctggttcgtcctttccaacccccttccttttaacctcaattttttattttgcttgagctcgatttttcccgtgttcggtcatgcccgattcttggggtatccttcatccctccgggttctgatctgtaggaacccttggcttctgcccgagcaagtaccgaatcatgttgtctcgttttttcatcgggaaattggggataactttattcccaattttaccatacacaactttcttcaactaaaattgagcaaaaaaaaaaaaaaaagaagagagagacagacgtagctactactctatgggtactatcttcacgtttctgagaatgtattggacctttatttcttaaaatagaaatacagtacattcttttcttgcatttgacagatcatgttattactagatacaaaagtacacatatgctaggcgtgtcctttatatagattaaatatatttccgttaagaaaggatctcaaatgactgaaattttcagaaatgaacgtgactgcggttctcgagatatatcatttctttaattgaagatcagtacattatttaatttatcatcaaacattattagaatactacttcctctacgtgaacctgtttgactgggcacgaagtttaaaaaaaaatgaagatttttagaatatgtggtcctaaacaagtccaaatgggccccaaagtatttgtgtggttataaaagcttctcattaagggtagagttcattctttttggaacggaccaaaaagaaaataggttcacgtaacctagaacacagggaagtaataaaaataaaaggcataacgtacacgtggttaaaattgcaccttcgcggaaattccaaaaggaaaatgaaggtactgcagagtctagagctacaatttgaagggcaagcgtataaatagacgcacgcaataagccctagtaagaacaagttcagaaactattcatcaaaaacctaattagggcaaaaaagaaaaaatgaatccccttgataatgcaaccttctttttctctgaccttgattttcttgactctattgagcaccatcttctgaatgattccgatttttccaacagtttttcgccgattagctcgagcagtgtcgcaactcctaatagtcctagctcatgtttttgcagctgccttttggatgaaaacattgaagaaacaacaactctcgaatctcaatccgagcccgaggagccaacgcaaggcttaaaggcggcgcgtgcggaaaacacgaagcaaaattggaggcggtacataggagtgagacggcgggcttggggaaagtttgcggcggagataagggacccggagagaagaggcgcgagattgtggctaggaacttatgagactcctgaagatgcagcattggcgtatgatcaagccgctttcaaaatccgcggttcgagagctcggctcaattttcctcacttaattggctcaaacatgcctgagccggctagagtaaaagggagacgtcataattcacgctcactggagccatcgtcttcttcatccaccacatcatcggaaaatggaagaaggaaaagaaatatagaggtcataaattctatagccaaagccaaattggttggtcatatacgcgatctagagatgtcactataactaatggaaaagaagagttttcagttcttttttcaaatgtcgtaacattactgcataaataacttactgttcaatcatgttattttcgctagtatatatgttcattatttatgttttgtacgtagtaattaatggggtgtttcaactttgtttgagcttcatagctggccaaggtactttgcggagaaagcagatgcaaagcagacaaaggagatgacaaaagtaaagttaggctcagaaaagcgtaaataaggaagaggaaagccgaaaaagaaagcgggataaaatcccggagacacccaagtcaagcagcaaaaaatctgaatttggaccttccacgagtaaatggacggaaagtgcaaaaaccaatacctcagttccagttccacagaaaactgaaaaaggatctggcaaagcccaaagtgatggtctcaagggaaagaacaggtcccacggatgaagacactcaggtgaccactttagctgaaaaatctgcaccaagcatacgccgagtgaaaattatgcgtgagcttggtttgatggctccttctggccggtatccatttcataattaaggggaacatgtttcttcatttattcccaagggacatgtttctgctccttccaggtcttcatctcatcctaaggaacgtcttcctccaattcagagaatagttgtttgtggtctatctgctgctagatccgttatgaagtagcttttgtttctccgttggtaagtcagagtcagacatgatatagactgctgaaactcccaaggtagtgctgaagttgtcatattagagggggatttagactgctgaaactcccactactttttctgacgcagagtttaaagttagtattaagaatgtatctttacaacatttttactacatgtataactcgaacaaaagacagcgggtgaataaacctgctgtctttgccaggttgttgcgaagttgtaataccaattgtagaaatacacttcttttcgcgttccccttcatagtggatgcagctaagatgcctattgagtagagcacgagatctgccactacaacacgtctacagagaggctaaccatgcggctgattcgatggcgaagaatggaagcagcttaccaactcttggaagcttaagaacttatctaattcctcctacttttgttatttcccatttgtaataaactatgtaatgactcttagtatgtgtttttaataaatgtctttattaccaaaaaaaaaaaaaggatgcagctaaagaaacctgagagtaattgaggggtaaatttcacaaatggtcatataactatgactttttttcatcattgtcaaataacttcgttttctcacacaaaaatcatagtggcagaaaaataatttttttggtacgattttgttattttactttttttattttttattttcaatctaataaataattatccaattaaaataggaaaaatactaatatatttttagttgttcccaaaaataatagccgataaaaaatattatatatatatatatatatatatatatatatatatatatatatgtgtgtgtgtgtgtgtgtgtgtgtgttttatacatataatatacacattctatatatattttggctagcaaatacaattagtttcgggcggtcgataaattttatatttttctctttaaatatgaatgacccaatccagcttgacccaatacccatatacgtaagttaaaataatactaaaagtgaattcttccctcataagaaactcagttcggaatgcataagattctgataaaaaaaaagaaaataaaaggtataattagagagcacttgaaataaaattgttatcgatttgaataaaatcttgaaaataaaaataaaagatagaagtatcatgttttgaagaatttaatattcattcctattttaattgagttattatttattatactgaaaataagaaaataaataacaacaaaacaagaaaatactaccaaaaaatttatttttcggccactatgatttttgtgtgaactagtgaaagttttatgattgtgtgagaaaacgaaattatatgacattgatgaaaaaaagtcatagttatacgatttttgtgtgagaaaataaagttatatgattttgataaaaaaaaaagttctagttatatgaccatttgtgaaattacccagtaaatgagggttaccctcttaaaagaaaagaaaaaaatggagtagtaattaatgttagatgtttgttctattttcttatgagttttttttcttttagaagcaaattataaatcaccatatttggttcgtcatttttcttgaaggaaaaggttttagacttctataagttgaggatcattccttctcatccagtagcatccacaatataatcataaggagttggagagtcttgtttgggggagaactttttaggacaagtgttagcgtgccacttgtgtttgcctctttgtgttgttgttctctcgatattttgtactatcttttatatagtggattgctcatctccgctcgtagacataggtcaattgatcgaatcacataaaatatttgtgtttcatttgatgttttgtttttgtgtgtgatttattgtcgttcaaggtttgctttactagcttccgcatgacatctgattattttgatcctagcaattaatgctcattaaatttgcataattttttcaaggacgaaaaaatgtcttttagaaacttgtttaaaaaaattatatttggatatccgcggtttaaaaaacgtctttttaattagaaaacatatgctgtttaattaggtatatgttctctaagaagttgaaaatattaactctaattctttactttataaaactatcaataatttcaactcattaaaatttacaagtaaatcaccattctttaaccatgtcaataaaatactacttctataaggtatatattcaatgtttaatgatttagaaactgatattcggcaatcaattccggtttgtaatgatccaccttagtttctcatttcaataacatccggtcttctttaggaaagggcaaaaaaaaaaaaaaaaaaaaaaaaatatagtagttaaagtagacttgacccgtactgtaggcttcctcttcacttctgcaatttggacacaaaaacaaaaaaaatcataatcatatgtaatcttctctaatattgcacatgcgtatttgataaatttaaattatcaaagactttttaattccctacactgtatcgtcgctgtacttgaatgaatatactaatcatcaaggttctttttgtactcatttttttatttattagatgtgtactttctctaacaatcatagagccatggtggtactaattattgttaaagaagtggctgaacaaatttcagaatattcacaaaaagtgtcaaatttagagctcccccatataaaattaaagtcgatgcagctcgtctttaattaacagatatatttaagtgaattatcaacccagctgatgctacactttgatattatgatgctccaccaactggaaacgaaaatgagaaatcaaataggtcttgaaatataatcatgaatttgctgatattctaaaggtcgtcccaataaacaaattataattaaagagaagaatccatagtaaaaatgtatttaagcattaaggggttgtttggttgaatgaagtagataaaataatgtatgtattagataaaatagtgtatgcattagctttgtatactaataatatcttgtttcgtacattttttaaacatatacattagtcacgcaagcatttgttatacaccttatttggtattatcctatgcataactaatgcataggaaatcatagtattaacaatgcaatgattttaatgcatgcattagcttagttaaagacaaaattgtccttcaaaatttatgcttgattaaaatatgctattatattaatgaaagtttgaaataatccaagaaagggaaaaataaaattatatccctagtaaataaataaatacttagcatatttcctctttataaataaatattcaattctatactaaaatataggtagacaaatcaaatagtttttgtaaaacctttttcatataaaaacactcctcaatatatgtttttttataaaaagataaagtgatggactggtcatcaggatatttttgtaaacaaataattcttttagaaattgtacaatattttaatacatcaaatcgaaaaatgaataaaaaaatatgtcaacattaatgccaacataactaatatcatcattattaataaaatatattaagcattattcttctgcatcctaccaaacgatccctaaatacatcttaatcttcaacgaaagctgggccgtgaaatatcgtgtgctagtattatatcctcgcgaggtcacatttcgaaaatatactggacctttctttcttgaaatggaaaataaaatgcttctaaaatttatcagctcatgttatcagaaaaccagtaagttttttgagaaaaagttatacatatactaggtttgttctacgaataaatatctctgttttaaagtactgatctcaaatgataatgaaattttcagaaatgaatgtgaccttatcgtgatgcgcaaacatcttccatatctcaagagaaatgtatactcgttacttacgtttcaatttagatgatatatttcgacttgacacaaagtttaagaaaggaaagaaaaattttgaaataagtggtcctaataatttaaggggtaaatctttgtgagattataatatttttgtggctataaaatcttataattaaaggtaaaatgagtaaaataaaaaaatttaaagtcaaattattttttaatataaaaatgtgtcattctttttagaacggattaattaataagaaaaatatatcatttaaattaaaacacaacgagtagagtatatcatttcttgaaattgaagatcagtacattattttattcctcgtcaaatgttaagataataaaaactaaaaagcataacatgtgcttaaaatggtaccttcatagaaattccaggaaaaaaaaaaataaaggtagggactagagctaaaattataggccaagcgtataaatagacgtacagtatcaatccttccattcgtccagaattaataaaccctagttattagtgaaagtgcaagaaacatttgttccaaaactcttagagaaaagaaaatgaattcagcagatgtaaccttctctttctctgattttaatctccttgaatccattaagcaacatcttttaaatgattcagatttttctgaaactctgtcgcctatgagttcaagtaacggattgcctaacagtcctagctcaggttttggcagctccctttcagcagaaaatagcttcgaaatctccctttcggaccaaaactttgaggaaacaataccaaatctcgaagaaaagtctgagtccgaggaggaaatgaaggggaatgtggtggcgcgtgagaataacgcgccggaagattggaggcggtacataggagtgaaacggcggccatgggggacgttttcagcggagatgagagaccccgataggaggggggcaagactgtggttaggaacttacgagaccgcagaggatgcagcgttggcgtacgatcaagccgctttcaaaatccgcggctcgagagctcggctcaattttcctcacttaatcggttcaaacatgcctaagccggctagagttacagcgaggcgtagtcgtacgcgctcacccgagccattgtcttcttcgtccacctcatcatcagtaaatgtaccaagaaaaaggaaaatagatgtgatcaattccatagccaaggtttgtcatggttggaacctccacatgttactataactatatttggaagggttttttagtgttttagtattagaataacaatttttatttttttagaactaaaacattttagctcactccctgttagcccgctaacttcaagctgggcctcaaagcattggttaattgttaattacccttccgtcttatattatgtgtcatgtttttcgtttatacacctcttaagaaatactaattgagaaaggaattgtgtttgcaacaaattatttgtgatacaaatataaatcgtaaccacaatataaatatgaagaaacacaattttattgataaacaatgtgggtacaattctgtttatcccttgattcttccctccgctttattctaaatgattcgacggtcttagcggtgtatttctcgaacatagaactttaagcaaaacatatttgacatgtctttgatctcttaatgaatattccaagagtttcatggaatttcggagatctcatatttgatctctttgtgcatattacgagagtttattgaagtgttgagattgtctttgaagaacatatatagccttatttataggcatgaattagggtttgggtgaagtagccaccaagtaaccctaatagactcctaatatttcaagagttgtcatgaatttaggatttatcttgatatgttaaaatttcagtgtctacagattggactattctacccttatctatgtctcaagatataacctctcttcattgaatatttaatctatttatatgttatctccatctttaacaacaattattactatgggtaaaaaagaaaaaaataattaattttgtcttgaacttctaaaatgacaaataatttgagacaactatttttagtaaaccacgactattaatatgagacgggggagtagaaacaattcctttattgcaaaagtcaaaaggtttaatcaaaatatatttgctccaatttgcatttaagaaaattacggattttctaattcaatgatgtacctctcgatcgagagtatttacactgctgtaattttgtttaattagttctaataaattgttaggagtactctgtctaacactttatagtttggggtggtgttacttcaacatgttcccatgaaaggtggaggcttccaattcacttctgcaattttaaaacttatcataaattaatcatggaatcttttctctttattgcacatgctgtgttctgacaaatttgtactattaatttactttacaatttccaacattggatcatcacgtataaacaattaaaagaaactatataatcaccaaggttcataaaactaacagccaattctttaacattccaaaacatagctttatatgctggttgactatgcagaaaaagctacccacaaaggacagactggcgcatagaggtatcaatacagacggcatgtgtgttctatgtggtgatgcaatagagactgctggacatatattttgtgaatgtcaattctcaagaagatgcataactacaattacagtggctaaaagtcaatattacaaacactgaagaatatggagaagagtagcaagaaaaatgggaggtaagctaagtagagaatttgcatttgcagctttggcagcgactacctatcatgtgtggaaagggaggaatgaagccttatgacagaattcagtccctagaccataaaaagtatctgaacaaatcaaagaagaatgtaaaggcaaaatgcctcatattccaaaaaagttcaaaacgcctgatatttcaaaatatgatggaacaacagacctacgagatcacgtgactgcattcacaatgggcgtaaaaggcaatgatttgactaagcaggagattgaatcagtattagtcaaaaaatttggtgaaacgctcaccaaaggagcgctaacatggtattctcttttacccaaaaattctataaatttttttgctgagcttgcagattctttcatcaaagcacactcgggagctcaaaaagtagagaaaagaatagaggatattttcaaaattaagcaaggggactcagaactgcttagaaaattcatggacagatttcaacgtgaaagaatgacattgccacatgtacctgacaactgggcagctatagctttcacaaataatttgaatgaaaaaagctcggaaactacgaggagactcaaggaaagccttcgagaattcccagctacaacgtggaatgatgtttataacaggtatatcacgaagctgaggattgaggaagatactgttccacgatttcaaaaagaagaaaaggtaagttcaagacgtgcggagaccgaaaaaagatccggtaaaaacaggtacgagccttacatgggacctgcgggaaaggactcatggtcaaagcaggataatcaaaggtacgatcacagatcaagaaacagagaatcaggttcttcatcaagattcaggaacgagcgaaacaactatgagtcacgagatgataatagaaatttaaaagcgagattcggtggttacaacttcaacatcagcacctccgagctcgtagttgttttgagaagcatgggagataaagttcgatggccaaagaaaatgagatcgaatccaaacaggcgcaaccctgaccattggtgcgagtttcataatgaccacggacataaaacaacagattgtagatttttacaaagtgaagttgattatttattaaaacaaggatatcttattgagttgttcagtgagaaaggcaagcaagcttacatgaagaacaggcaggagcctccaaaaccaccttctcccaaaagagctgtcaaagttataagtgggggtgaagatgttaatagtatatcatatactgcagctaacaaaatttccaaagtaacaattacccaagggaaatgggtgcggcatgttttagaggaagacaacattacattcaatgacacagatgcatatggcatattaacccctcataacgatgcactggtaatatctttaattgtacatgatactaatgtgaaacgagttttgattgatccaggtagttccgtgaacattattttgctaagagtattacgtgagatgcaagctaaagataaagtgataccaaaggcgcatactctatgaagatttgataattctagtgtcctcacgaaaggagaggtaacactcaccacattcgctgaaggattcgtcaaagatacaaagttctaggtggtagatatggagatggcttacaacatgattcttgggagaccatggatccacgaaatggatgttgttccttcaaccttacatcaagttattaaatttccatcgccatggggaatctgtcaaattcgtggagatcaacatacatccagggctatcaactctgttgcagatacaagcacgagaaataaaggtaaatagcaatcacagaaggcagttgaggatatcacaacacaaacctcaactgaacaagggcaaacagatgtagactcaaggcttgatactattcaagaactagaagagaatgaaaatatcaaaacaacaatagaggaattagagcatgtcgtgctatttgctcaatggcctgataaaaaagtctatgttggagccaatcttagccaaggtatgagaggtaagttaattagatttttgaaaattaacatggactgttttgcttggtcccactctgacatgacagaaataccatcggaggtgatgactcataaactaaatgaagatccatcataccctcatgtcaagcaaaagaaaagaaagcaaggaactttcaagaatcaggtgattcaagaagaagtccaaatattgctaaaatttggttccattcgtgaggtaaagtatcttaactggttagctaacactgttgtagttccaaagaagaacggtaagtggcgggtttgtgtagattacacagatcttaataaagcctaccctaaagattcttttccactaccacacatagatcaattgattgatgcaactgcatgtcacgaactattaagttttctagatacatattcaggttataatcagattaaaatggatccgggagatgaataaaaaacttcattcataacagacagggggacttattgttataaagtaatgccctttggtctaaagaatgcaggtgcaacgtatcagaggttagttaccaaaatatttcaagagcatttaggaaagactatggaggtatatatagatgatatgcttgttaaaactcagtattcaaaaggtcacatatcacacttatctgatacatttttaattttcaaatttaatatgaagttaaatcccgaaaaatgtgcatttagcattgcatcaggtaagtttttgggttttcttgtttctaaccgtggtattgaagtgaatcgtgcatagattaaggccattgaaaaaatccctgatatactttcaaacaagaaagaagttcaaagattaacagggagaattgcagccttgggaagattcatttctaaatcatcagagaagtgttttaaattcttctcaacccttaagaagcaggatcattttgaatggaatgaggaatgtcaacaggcactcaggaatttgaaaatgtacttatcaaatccacctttgctggcaaaaccaaaggctggggaaagactactcatttaccttgctgtttcggaagttgcagtaaacgttgttttggtaaatctttgttagatgcggaaatgcggtatcttcagttagaaaaacttgcacttgcattaatcatggcatctagaagttaagaccttactttcagtgttatcctatcgctgtagtaactgcctaccttttacgtaatatattacataagcatgagttatcaggtaggttagttaagtgggcaatagagttaagtgaatacgaaatcacataccaacctagaactgctataaaatcacaagtgttagctgatttcgtggctgattttagctaggggatgcaattaaaagcagaaaaagaattacaggtattcaatggagctaacccgggaacttggactttattcactgatggctcatctaatgtaaaaggtgcaggtttagggattgtcttggtaccacctacgggtgaaaacattcgacaagctattaaatgtcattccataactaacaatgaagtggagtatgaggctgtgattgtaggtctagaattggcacgagagcttggcataaatcagattataatcaagaatgattcgcaactcgtggttaatcaaatgctggggacttatacaacttgggaaacaaggatacaacaatacttagaaaaggtacgggaattgataaagcaatttcaaaccaggaaagttatacaaataccaagggatgaaaatattaaagtggacaccctagctaatctcgcatctgcagctgatgtggcaagtgatgcaaacacctcagttatacatttatttcattcagttctcgatcctgataagaatgaggtaaattttaataatttaacttgggattggaggaatgagattgttgcttttttgcagtatggtatcgtccctgatgataagaaaaatgctcatgcgcttcgaaagaaggatgctcggtactgcttaaagcaaggcaatttatatcgtaaaatgttcggtggtcccttagcaagatgcctcggacctttgcaaacggagtacgtaatgaaagaaatacacgagggacattgcgggaatcacgtaggaggaaggtcattggtaagaaccttaattagggcaggttattactggcctaaaatggaagaagaagcataaagtttcatggccaaatgtgataaatgtcaaaggtacggtaacaatatgcatagacctgcggagttattacattcggtcattgcgccatggccaatggatatcgtgggtccgctaacacaagcaaaaggacaggtaaagtttatgctcgtactcactgattattttgctaaatgggtagaggcaggagcatttaaacaggtgcgagaaaaggaagtcaaagattttatttggcggaatatcatatgccggttcggtgtaccaaatgagatcgtgtgtgataatggcccttaatttattggagctcaaatcacggaattctttcaaagttggaaaattaaaaggatatgtctacaccttatcaccccgtgggtattggacaagtagaatcaataaacaaggttattatcaataatttaaagaaacgattagaggaatcaataggtaactggcctgaagtgttacctggagttttatgggcatatcgcacaactgcaaaaacaagtacagaagaaccaccattttcattggtttatggagctgagaaaccaatgtctattattcttcttttgtagggttataagaaaaaaaacccgtgtctattattcttcttttgtaaaactctgttaccagaaaaacagttatgagaaagttatagatgtaattcaaatacatgtaaagtattattcaaaacttgtcaaggttatttcaaagaaacatgtctgttcctatttcttttattgtatgataacaccattatgaagttgagacgtcttcttcattaagtgtcgaaatataaaagagccctcttttataaaactcatgtttaaattagttagtcatgagattaacagaagcattttcgaagaacaaaaatgcaaattattctataagtccttaaaaataaaggcaagaataaagcagacagaagtttaagataataacatgaaaaacttcttaatatttaaaaactgaagactaagtacgagcttagtcataaaactatgaaattgtttatacaaattgccccataaaaaacttggggacttgcattttcaaaaccatccctcaaatgaagctaagggtttgattacaattttccaaaataaaaacaaaaacaaaatcattcaaatgattaaaactggtcactgagaagtttgtggaactgaagaaggagcatcaatagcagtgggctcaatttgggcaggtgcatcaatagatgcggtttcaacttggcttgcagcaacaggctcgattgggcttgaaagagttgggatacccgtatcagcttcaacattcacgggagcttcaaccacgggataagggaagtcctgagtttgctgagctttttcaatggtttcattgatcttagctaactccgactccaggttgaagttttcttggtcagcttcaattagggtatcacgacgtgaattcaaaaatgcccaacttacctcaacatcagatttttctttaaggatctcataatcattttcccaatcagcaatctcattctttatctcttcattttcagccaaggcggagttataagaagcttgaagagaggcatgggagctctctaaggaatgcaccttatcagcagagactcgaaggtcttcttgtgcttgagttaagctttgcacgagctccccagcgtaaacttcttttgactcaaaagagccttcaactctctgttctctttactggccttagatagttgctctgagaaggaggattcgagacgttctttttctttttctgcttggcttgaggaagcttttacaaccgctagctctgaagttaaagtccacacctgctgctctaaggtattcttgctctcttgtaaatcttccatatcaatttgtgcactctcaaattgttccttccaattgatcgcctccaactgagaatcacgtgctatcttctctgaatcacatgctaccttctctaagagggggattttgtttatcatttttgtgccgataaaattggcctaaaaaaaggaagggaaataagaatcccaaagataaaaaaaatttacaaagtaaagaagggagagaaggaaaataccttcaaagtggcatgcacgatctcattcattagagtcagggaactatggctctccagctttgctttttcaattgggtcaattaaaggctccagccatacatctgccagacctgacttcctcaaaaggctgctatcagcaggaacttcaatagttaccctcctcatagcgacacttctacttgaagagcccactttcgtatgatgaacgataggaaggggaatagtcaaaggaggagcggtagaagaagtgaaaacagtagaagaaggaacagaaatagctggggctggtaaggaaggaatcacaggcacgggagttgaaaaagaagataagggtatttcatctaaaataggccctaaacttccactaccaaaaccaatgatgaaaagttgatcaatagactcacgggtatcataatgagtgatgtcatcgtcaagaattattactggggtttcaaaggttcggtaagagaaacagaaagacggggggaaacttcagcttcgtcatcagagacgatgcgtctcctagctcgtggcctcatcaccagggagcccccatcttcctcttcttcagaattttcctctttcaacagctttccttttcgcagaagaacccaagactatttcccgggctctttctgaagatatacgggtccccgaaggagtacgggttcccgaagagacacgagaggtcgcaactgcttcaacagtaactcctcgaatagcaaatcctgataaaaagaaggatgggagttagagaaataaagaaaaatatatatatgcatgaaagatgaaataaaaactcttaccatgagtctttactttccaaccgtaatggttagaaagtgttctccaagacctaccatctattggtgcggtcttcagcaatttatctacccaatcacggaaatttggaatatcctccacaactcccatggttgctaaaaaagggcaaaattagagaagttgataaaattgaagaaaaaaaggcacgagaaggataaaagacttacgtgcaaaattccacttcttatagaagggaacgttatccttacccactaagccaacactgggggcagcaacaaaccgggcataccatccacgatccttgtcatcttcagggctcaccaaaaccctcttactcctggccactagagtaaaaacgctattacggaaaagcctaggggagtaaagatgaatcaggtgagggaaagtaaaggaaacgtcagccatattggttaaatgcctcaaacatccaacagtcctccatatgattgggccaatttgacccaaacagacattaaagaaacggaaaaattcaagaatgactgggtcaataactggtttgaaccctaaagtaaaagggtatgtataacaaaagagaacccagtcaagtaagaagtaattctctgatttggattagggataataatgggaaaatcattactccaatggcaatctttgcgaactacaagagtcaaaacttttgtaatttgagtggggtaagtatcaccacgatctaaagcagaaacatgatttttaagagattccctatcatggtaaaaagatagttctgtagggactatctcctctactaaaggctcacgtaatggtttagaaggttctttaccactagaagaagatttgtgagaaagggaacctctagttctagaagaaggaccagaactaggagaatgtatatacgaactaccaccacgagtagaccctaagctacgaagcctacctcctcttttatgtctaatgggggaattggggaaggtatcaacaatgggaactctcctagggttagggtttggtgaagacatggcgaagaagaataatgtgagaaagaagtgaactgagatttgaggaattaagtgttcaataagctttatgtggtaaaagacaaggaaagaagttatatttatattaataagcaatcgtcaaagttaaaagtgcagtaatggaaggaccataataatgataactggcacttcgtgaatagtagagtcgtaaaaaagccttgaaaagggatgcaaaactgtagaaccaatggaaaaatgacacgtgtacggagcattaaatggaagcgacaattgaagcgtcaattttgtcatagcattaatagtgacaaaaattttcttttaatgaaatccactttccaaatattcaattgatgaataaatggaaagtggggggactatctgtattggaaaaaattgtatttaaatataaaggtgacgtgtcgagacacgtagactggtcaaatggtcaaagaattacaactagccaagaggcacgagttgcaaagatacgatcaaatggcagaggaagaggcacgggcagttattcaaataactcagcgcccgtacctatctaagtcatttatgtccgagaatcaaaggaatgaatctgacaatagaaaagagtgcagatacgacatttaataggcattaaatgtggaatacgttagagaatttgtattgaatgtaatgattatgtaacgtagcattcaatgtctttaattactcataatagcctcattatgatttgggcaaaacgtatatctccaaaatatctataaaagggagatatctgatcaattgtaaaaaaaagcactattgaaataaactttggtttacttttttctcttgattactctcttgctacctaaattacttccttttatacattcttttgattatcagtaactcgtgttcttctaaattctagctttgactaaaatttcattttttggttaaacagaaatattcaacaagcggaaaaaggcaaggatagaagatggatagaggatatatataaatagaagtatacatgtacaggtctttatataggtagaagctagaaggagctacttcactgtttttccttcattgtattccctttgttgttcccttcgttgtatttgttttggagatgaataaaaaaaattcgttccaccaaaaaaaaaactaatcgttaacaagtggaaaaacaaataactttataatacactaaaaaactaaaggactcctataattaatgtcgatacagcttctctttaagtaacatacatgcaggtgaattatcaaccctactgcaaattatgatgctaattatcatcttctatctatttatactatattaaaagtgagaagcccttagtcaaagttaaattgcagaaatgccccttaaaaaatctaaccctatttaataataagagcatcaaatttatgtgaaggggatgcgaccttcagaatagttacattacaaacaaatgtttcctatttataatttggtttcctactgttactactcttagttgattagacaagttttgggtgttatcattatttaactaatggtctacgtcacttgcatgatgaatgtggattataggatatgaattatagggatgcatttatagagaagatcaagtatttcaaccagaaaattgtaagcgcaaacttcacaaattatactgtgaaaaaaattcagaaatgtagaagacgaagaatagaataccctaatgtgctggacactttctatggattgggcaaaatattttagtagaaaagtcgtggaggtttatctaaatttgtcacaacacaagcagcgaaacaacaattgactgtgagaagcaacaaaaaataagattttgatctctttgtccccaaatcaacgtgacaaatggtgcagccaagaaaaaattaaaattcaaggtgaacaaaaaaaatggtacaaaaatcaagttctatttcttctctacttatttatcttcctttaccttttttaatgttgagaaacttattttcataaatgtttggataatgacaactcttgtaataaacgttaaatgcatatttgttgtgtttaggaatggcattagttaatgctatagttaactttgttattttattgctacaatgagatccactaataacgtaacatattatggttacatgcataaaaattatatatgtggaagtttactttaacttgtgggatgatatgaagcaattttatttggaaaatcatatatgtaaatcacgagaatgaataaaactttcatttggatattatttgggatcatgagaagaaacaactaaactttgattgtttatttttgtaggattagatgatatccaatcattttaacctcgacaaaatatcattatacgatgattcacattaatcgttatcagaaacttatacttattctttcacgtataattatttactcaaaacttttaataatatttatattgtattattttacaaaagcatggactacataacttgccatacacgataatgattcacattaattattatcagaaacttgtatttattctcacatataactatttactcaaagctttatttcaaaatatttatattaaattattttacaaaaacgtatattatataacttgacatacacatgcaacgcatgcggcgagaaactaatattatattataagtgggaagccttttagggtgaaagttaatttacaaatttacccaacaatagttgagtgacgattttatccttacaatcaaattaactattccacatttatgtacaaaaaaaatgtaatttcaaatgttatcctacatgctttgaacgagcatgataaagggtgctagatttaataaatactcgaattgaaacgtcaagttcaagaacttgaacgacaacgtcgggttagcttcatgttatctttcaattccaaagggtctggaatcataatttgtcaccctacctcttcttaaagatcaagttgatcggcttttcatcatacgtttgaaaattaaaaactgttgttaactaattaagcttttcagtcaattgataatttgccaagaaggagatgcatattctaatagtaggttactggtaagagtgtaagactatcatacagtacaaaatcaagctaggagagattgtcataacaatttctaccactgggtttatggtgtagacagtggaatacaagaacatacgattcaatatatggtgtagatagtgggtttttagagacattcttccaaaacacggaagagattatgagaagttcactggcttagtaacatcttcacaggtagagtttagaagccataaccaaaaaaaaaaaaaatcgatataatttgtttgacgtggacatgaacaatgttttgatcatttttgtgccttacttacaacatgtttttccatttactaaagtcaattgatcattctctgtttagaactttgttatttcgttagactcttaattttagatatattttgtagattaagtagagtatataatctttgggttttttagggaactctgtctaattgtttgcttttactttgttcaatagtatagatatttttcgatgtcggatccaaattttaagatcttactaactctttcatactgtatttttgctttgttttctaatgcactcttagtaagaagatgtatttctttgtaaatttgtgtatcatcttcaaatatttttatgatatttaatttgactaggaacatgaaagttccacgttaaacaaattatgtcgaagaaattttttggttatgccttctaaattttacctgtgaagatgttgctaagccagtcaactcctcataattttttccgtgttttggaagaatgtctctaaaaaattaaattttgtcctgaccaataatatcaacatatgtcatcactcttattttcgaggacttcaattttctctttaatttttattttataagtcacatatatttttagtgatatttactttatttaaaaatagtttatattcatggctaataagcagacgcgcagaaactagttaaaataaaaaggagaaatcaattgcaattcatctacattcggaactaaaataagtccgataatagaaaatagtgcaaaaacatcgttttccttgtgcattttgtcgggtgaaaaacattttcctcaaaaaatgtattctgcggattgctttgcatcgtaaaagcattttctggatcatttacaagcgtttgattggttataaaaataggtaaacatattgtaccaaacacacatgggatacagttcaattctttatctgttgataagactggagtttggagatcttctcgcaagccatgtgcaacaaagatctataagattatgtccaccttgtcaacaaagtaatattatatttaagcattaattacatcttaaacaaaacttgagcagtaaaagagagcagtagccaggagcccaggctgtagccatacctccatttctttttttcttttttttgcatgatattatattaagctagttagatgtttgttacaagtatctgttggtacactatccacaaactaagaatagtcgattactacgttagaaatagtacaatctttatctttctttcaaaaatagttcttggggtgtattctaccggtaatatttccttgacaaacactggaggaactatcaaaaagttgattcttgttcctgcctgcttcgttactttctttgctagcttgtccaccaccctatttgcctctctgtagacatggtgcatgcccagagctactaggagtgacctatattcacggaccatagcatcataaatcagatgacctttgttattgcaatgaattacttctgctgaatctaagttaacttccctggggaggagattgtactgccatctttatcccctgcataaaagttgttcgctccgaatggattgtattaatgcagttaattttccccaagaaccccattactcagtccccattgatgttcctaattagtcctcctatacctcccattctttctttttggtaagttgcaccatttgtgttgagtttataataaggcctccttggtggatgccatttgactcctattccaagatctggtgcttttgccgggcatccacctgccacatgtatgaactctactactttagctatagcattcttctagggaataggctctctcttgttattaaaatagttactatttctggcgagccaaatttgctagaggcgaagggattttcaattatatttacacctttctgaaaatctaatggacctttctttcttaaaatagaatatagaatctttcttatatttgagagcaaatgcaatcaattaaaccaaaagtaaaaaagaaagaagtactatacatatgctaggcttgcccttcaagaaaattatttccgttataaattaactgatctcaagtaattctgaaattttaagaaatgaacgtgactttgtcgtggcaaacatttttcaaagaggaatatatcatttcttaaaattgaagataagtacattattttattcctcgtcaaatgttaagataataaaaactaaaatgcataacataaatgtgcttaaaatggcaccttcacagaaattcctggaaaaaataaataaaggtagggactagagctacaatcataggccaagcatataaatagacgtaggatatcaacaattctattcatccagaattaataaaaccctagtaagtgaaagtgaaagaaaccactcatccaaatatctatagaaaagaaaatgaacccagctaatgcaaccttctctttctctgagtttgatttccttgaatcaatagaaaaccatcttctcaactatgattccgatttttctggatttttttcgacgatgagttcaagtaacgcattgcctaatagtcctagctcaagttttggcagctccccttctgcagaaagtagcttggatacctctctttgggatgaaaactttgaggaaataataccacatctcgaagagaagtccgagtccgaggaggaaacaaaggggcatgtagtggcgcgtgagaaaaacgcgacgcaagattggagacggtacataggagttaaacggcggccatgggggacgttttcggcggagataagggacccggagagaagaggcgcgagattatggctaggaacttatgagaccccagaggatgcagcattggcgtatgatcaagccgctttcaaaatccgcggctcgagagctcggctcaattttcctcacttaattggatctaacatgcctaagccggctagagtaacagcgcggcgtagccgtaggcgctcacccgagccatcgtcttcttcatgcacctcatcatcagaaaatgggacaagaaaaaggaaaatagatgtgataaattccatagccaaagccaaattggtttgtcatggatggaacctccagatgttactataactatatttggaagggtattcgatgtttagtattagaatcccctaaagctcctgaaggtcttcgtatcatgttctaatttaacatgaaattacatgagcgcatcatatatataactaagtagtagtactgttcgatcatgataataactttttgttagtatattttttcaacgacaatatgcttagtgtagaggaatatatacatgaatcagcaacgctggacagctgcttgagaactttctaagataattatgtggaaacgtctttttaaaactttttgaaacaatttttatttggatatctgctaccccatttagcaaaaagtaattttgagtacattttttgttttaaaaaaaacattatcaaataattggagaatacaaaaatacaaggaactaatttaatgtacatgatagatggcgaactaatgagggcaagtcaaaaagaagtactagaaattttttgaaaaggtgtgtatatgacactttagacaaatttcacattgttcataagtacatattgaccattcttgggagaaacagagatatgaaacgtgcattccacctaattatttgatcttgatgcaggcaatttaagccatatagaggtaaatatatattcatactcttatgatacctttgactttataatcagcgcacgagatccaaatatgatataatctattaaattaaaccaattatgtaaacggtatttatagtgccaatgcttaaaatttaaattctgtgtacatatattggcttgtgaattgccgccaaaatcgggaactatgccttccaagcaaaataattagcagcaaaaaaaaaaaaaaaaaaaaaaaaaaaaaaaaattagcagctccatccaaatgggtagagatattccttaccacggaataaactgataaaaaaaattgaagcaaaaaaaaagtttaaaaaaaattaagcccactggaaaattaagcataaaataaaacaaaaataagcccgttggtaaatttgatctaaggagcatcaaggttaaaaatattcttcaacggtgcatccaatcaagatatttcaaaaatctagagatcttattaatggttcttatattagattgaatccaaaatataatgtttaaattccttcttttcactgtaaaagcatatttgatgaatcacttttaggtgttccaaaatatttttgcagtatttctatgaaggttctgctttaattaaggagcatggctgatttcgttataaactattctacaaacaatttgtcgctattttcacccaagtgatgagattctcttttaattaagcaggaataaccccgctaaatacctgcttaattaaaaaaagaacctcatttcacttagacttctttattcttggaacagtcagcaataaattgtactcatactccatgtacacatggggatatctttttcatagtaataattaatgacgtgttcccacattcaatatgttcaatgcacgcgtggaaaagtaaattcaattcgaagtcatagatgtcaatccaattctattggagcaagaaaaatgcaacagatgctgtaacatttttttaagcgaccattttcaaaaaaatttaaaatgtacatagtctataactccgtttgttatgacttttttggcttcttattttgattcaaaataagtaacattttatatactccctccggtttaaaataagtgattttttttacctttttgtggtctaaaataagtaattttttcagatttcaagaatgaattaattatttttttccctacattacccttggagtaaatagtgttggagtacgtgttatgagtgtatatgtaaagagataataaaggttaatatggtcaatttcattgctaattaatgttaaaaggtgaatttcttaatctgtgtgaaaacaactaaaaaatcacttattgtggacaggagggagtaatgaagaataaattaactttgttttttcagaagttgcccttatttatttatttatcataatgtgtcaagttaacaatctgcaaattttaattatgggtaagttaatcaaaatatttttttaaaaaattattattttctttagaagtgtgctaaaggccaaaaagccacttattatggatggaaagagtataatattttagttatgtgttactcttttacgctataatcgagaagctatgtcctaatttccacatgggaaattcttgtaatggctaggaggaccatcctgaccacggtgtccctccatgggtcatgagaaaacttaaagagcgagaaaaaaaatatactgctttggatatataaacaaaatataatcatctattcacccaaattagaggtccgtaactgtaacgacctaactggtcgttttgctttctagaatctcgttcccttaaataaaaattttcgcgcttgctttaactaatttacgacctgaagggatggttggttcaggatttggaagatgttagggttgaaatatgttcatttgactccttaggattttcttaaaagggctaagtttaactttagtcaacatttttagcaaacagatccggattcatattttgacggtcccgaagggtccgtagaaaaatatgggacctggacgtatgaccggaatcgaattccgaggtccctagcccgagtaatgaatttttattaggaattgtcaaactgaaattctaaggatttaaagaaactaattaatgattgatcacattggtattgggctcgtatgttggttccgaagctcagtacaggtccaatataacatttaagacttgctcgcaaaacttagtgtcaatccgagtagtttaagggcgtttcggctcgttagaggaaaattaagaacttgaagttcataagttggatccaattggttttagggggtgattcttagatttagtgttgtttcaggcgttccgaaggtttgaatatgtccgtttcatgattttagacttgtcggtatgttcgggcggggcccgagatcctcgagcgtcaatcggacgaggctcgagtgaagttggactttttgagaagtgctgaagcatctgcttctgtcataactgcacctgcggttggtcgaccgcaggtgcgagatcgcagaagcggtccgcctatcacagatgcggctaaggcaggccaggcctaaaccgcagatgcggcctcgataccgcagaagtggtcgcagcccacttggccggttccgcagatgcgtccgatttctggcagaagcgggaccacaaatgcggtcccgtgaccgcagatgcggaaatcgctgaagctgtgagctttatttaatacgggttctaagtccctttttaccacttttcactcatctattggcgatttttggagcttttgagaagagacttccacctatcatcttgaggtaagtttatcccacctattcttagtttaatacttgtgtcttgggtagattaaactctaggattaaggtaaaacttatggggttagagaaaaacctagagttttggcaaaagttaaatttaaccacgaaatttgttataaaatgaattagaaatcatatattattgatccttaggttatggagaacaacttctttcgaaaaatttcggaatccgagcacgtgggacaggggtcggattttaggaaacttgtgttaatggttggaaaatttcttaaatagctagaattcgatattgtgagcttatattgactagttcttacctcatttaactagtttgggatcgttcggcttcgaattaagggtttggactcgttcttggtattggcagtgcactttggagcgaggtgagtctcctttctagccttgtaagagggaattgtccccgtaggtgtaataattgagtaatttgctactaaatgtgggggttatgtacgcactaggtgacaagagtctgtgcgtagctactattatgttaattgtccgggtagtctaggacccgtatcatgctatatttgtgaatgtctctatattttcttgctaatgtgatcacttaggatatgctagagacttggaaatgagtataagcgaatgtatacacttggacacttgtatgaatttacttggaaataaatgcgcatttatttgttttcttgatattaattgatatttgtggatcgggccgatcgcctcggtagaaatagatgcatctatggttcgcgtcattcgaccctctggcagtgcacagtttattttttgttggatcaggccgtagacctcgacataatgtgcgcatgataatgtgaaatcttatccatgacttctcttgctaaatacctgaaatgtaattggttaactacaaaattgttcagaacatcacttattatctcttgctacaaactattgattatttgtgactcacatgcttagcataacaccttattatattatttaaccctagtaagtatcaagtcgacctctcgtctctacttcttcgagattagacgggatacttactgggtacatattatttatgtactcatactacacttctgtacttaattttacaggatctgaggcaggtacatctggctatcagtctggtgtgcgcccctgactcatagttcgagatttccacggtgagctgctcccctcctgtgccgttcagcagcttgatggagtctttctttacttttgctatcttttctacctcggatagtaggatagttttattcttttgtaccttctactagttacccattacttgtgataccaggtcttggcacacacattagtagactattatttgggggttgtataactattttggcacattactgttcattcctggtttaactttaacttaatgaattgctgcacttattttggtaaaagtaaaaaaatgagaacttatttatatttccgcgttggcttgtctgacaataatgttgggcgtcatcacgatctattatggaaatgggtcgtgacaacatggtatcagagcactaagttcacgtaggtctcacaagtcatgggcaaacctaatagagacttgcggatcagtacgtagacgtctgtatttatcttcgagaggctatagggtgttaggaaaactactctttattcatttcttgtcgtgcagtagttagtatactaaatttccctattctattccctcacagatggtgaggacatgcacggatgatgttccagactcgggaggagctgctcccctcattgctagaggccgaggcagaggccgggggagggcaccggcccgaggtagggacgagggcatcctagagatgttccagtagccccatcagtagatcctgcgggatatcctatcatcgagaagaagggcgaggtgcccgcaactgagcctaccccgacggacttcatgacaacaccgggttttcaggagatcatgggtcatatgctgcgattcatggattccatgactcaagctggtttatttccagcagatccagctacatcacaggcaggggggagcacagacccctactgctcaggcccctagacatgcagttatagtatatctgactctgggtgcactacccacagatggggcccagccaatggctgtagtggcgccctagcctagaccagctgcggatggagacctgcagaagttgttggatagatggactagacttcaccctcctatcttcgggggtgagcgtcatgaggatgcccaagactttatagataggtgcagggacagactgcgcaacatgaggatattggagtcgcatagggttgaattcactactttttagctagagggcagtgcccatagatggtggcagtcttatgttcttggcaggccggtaggttcccctctcctcacttaggatcagttcgcacaattatttttggataggtatattccaccctcagagatgaaagagctgcggtatcagtttgagcatctggagcagggtcagatgtctgtgaccaattatgaggcgaggttttctgagttgtctcgtcatgcactcatgatactttccactgatgcaaagagagtgtgcgaagatttgttgcggggttgcaccccggtatttgagctagcatggaccgagaggtggagatgggtatcgagtattagctagtggtagagattgctcgcaagattgagggatatcgccagaggggtagagagcagattcagcaggataagagggaccgattttcggtagagttcagaggtaccccagctaggggtagaggtcacttcgggaggggttagcccaacagacccccatattcagcaccaccaccaccttcccgaggtgctccagtgagaccatattttagtgtgatgccggagagttcttaccgcccaccagcaattcagtgttcctccggtggttattcaggtccacaaggttcttctgattcttatttcagtggtatgccggagagttcataccgtccaccagctattcaggcttcttccaataggtctacaggccatcagggtcagccatcaagggagtagttcgccgcaccacgggtttgtttcgagtgcagagaccttagtcatatgaggagatactgcctcaggctttggggcaaggtagtacagcagggttagcagcctatgatttcagcaccggctgccccaccacctagaggtggagggcagattggtaggggttgtcctagaggtggaggccaagcagggagaggtcaaccaactactgcttagtcagatggaggccatccagccggcgctccggccagattttattcccttccggctaggccagatgcattggccttggatgctatcatcacaggtattatttcagtctgcggtagagatgctttggtattatttgatccagggtctacctattcgtatgtgtcatctctgtttgctcgttttctggttattgttcctgagcccttgggcactcctattcatgtgtccactcctgtgggcgattctgtggttgtggatcggatctaccagtcctgtgtggtcacattctatggtttcaagactagagcagatctctggttgcttgatatgatcgattttgagatcatcctaggcatggattggttatctctgtatcacaccgtcctagatagccatgtcaagactattactttagtgatgccagggttaccagggttggagtggaagggttccacagttgatacgtctagccaggttatctctttcctaaaggctcggcatatggtcgagaaggggtgtttggcttacttggcttatgttcgggataccaaaggtctccaacgattgatttagttccagttgttcgagagttcgtcgatgtgtctccttctaattttcctggcatgccaccgaatcgtgatattgatttttgtattgatttggctctaggcacctagcctgtatctatccaaccgtactgtatagatccgaaggagttgaaggaacttaaggagcagcttaaggagttgttagtaaaggggtttgttaagcccagtgtatcgccttaggatgcaccagtgttatttgtgaagaagaacgctgggactatgcggatgtgcattgattaccgccagttgaacaaagtcaccattaagaacaagtatctgttgcctcgtattgatgatttgtttgaccagttgcagggtgctaagatgttctccaagattgacttgaggtcagggtatcatcagctgaagattcgggactcggatgttccgaagactgcattccggactagatatggccattatgagttgctggtgatgtccttcagcttgactaatgccccagcggcattcatggacttgatgaatagggtattcaggccttatattgattcatttgtcatcgtcttcattaacgacatcttgatatactcccatagcctgggggagcatgagcaacatttgagggtagtgttttataccttgcgagagcagaagctatatgcaaagttctccaagtgtgagttctggctagagtcagtggcattcttggggcatttttgtgttaggagagggtattaaggtggaccccaagaagattgaggtagttcagagttggccacgtcctacttcggtgaccgagatcaggagtttcctagggttagcaggttattacagacgatttgtgtagggcttttcatctattgcattacctctaactagattgacccggaagggtgctcccttccgttggtccgatgattgtgaggcgagcttttaaaagctcgagacagccttgactacagcaccagtccttgtgttgccttccagttcagggtgtatacggtatattgcgatgcttcacacattggattagggtgtgtattgatgtaggaggggcgagttattgcatatgtttcgcgtcagttgaagatccatgagaagaattatcctgtgcacaatttggagttagccgcgattgttcatgcttttaagatatggaggcattatctgtacgaggtatcatgtgaggcttatactaatcatcgcagcttacagcacttgttcaagcagagggatttcaatttgaggcagcgtagatggcttgagttgctgaaggattatgacatcaccattctttatcacccgggcaaggcaaatgtggtcgcagatgccttaagcaggaaagcagagagtatgggtagcttggaattcattccagcagaggagaggccactagctttggacatccggtccttggcaaacagacttgtaaggttggatatttcagagcccagccgaattcttgcgtgcattgttgcctagtcttcattattagggcagatcaaggcccaacagttcgtgatccacatttggcagttctcagagagacagtgtttcagggtagtaccaaggagatttctattggcgaggatggtattttacgactccagggtcgcctatgtgttcctaatgttgatggtctgagggagaggatactagaagaggcacacagttcgcaatattccattcatctgggtgctatgaagatgtatcgtgaattgaggcagtattattggtggcagaagatgaagaaagacatagtggagtatgtggctaggtgtttgaattgccagtaggtcaagtatgaacaccagaggccgggtgacctacttcagcagatgcctataccagagtagaagtgggagtgcattactatggatttcgtagttggcttgccccggaccttgcggaagtttgatgcagtgtgggtcatcgtggataggttgaccaagtcggcacactttataccggttgtgtctacttacacttcaaagagactggctcagatttacatccgggagatagttcggttgcacggtgttcctgtttccatcatatcagatagaggccctcagttcacttcgcatttctggagagttgtttagggtaagttggggacctgcgtggagcttagcatagcattttatccacagaccaacgtgcagtcggagtggacagtccagatcctagaggacatgcttaaaggatgtgtgattgactttggagggcagtgggatcagttctttcctttggtagagtttgcttacaacaacaactatcattccaccattgagatggctccatttgaggctttatacggtcggcggtgtcgttctcctatcgggtggtttgagcctggtgaggctaaagttatactgtacagatttggtgcaagatgacttggacaaggtaaagttgattcaggagaggcttcgcacggctcaatccagacagaatagttatgcggatcagagggcgcgtgatgtatcattcatggttggcgagaaggttctcttgaaagtctcgccaatgaaaggtattatgaggttcgggaagaagggcaaattgagcccaaggtttattggaccctttgaggtgttgagacgagttggggaggttgcttatgagcttgctttaccccccagcttatcgggagttcatccggttttttcatgtatcgatgcttccaaagtatcatgccgacttgtcccatgtgttagactttagtactattcagctggatgagagtttgggttatgaggaggagccagttgccattattgatagacaggatcaccagttgaggtccaagaggatttctgcggtgagggtccagtggaggggccaaccagtcgaggaggcgacctgggagttcgaggaagacatgcggagtagatatccatatttattcagcagctcaggtacttttctatgttcattcgaggacgaacgtttgtttaagaggtggagaatgtaacgacccgactggtcattttgctttctagaacctcgttcccttaaataaaacttctcgcgtttgctttaactaatttacgacttgcggggatggttggtttgggatttgaaagatgtttgggttgaaatatgttcatttgactccttaggattttcttaaaatggctaagtttgactttggtcaatatttttagcaaacggacccggattcgtatttttacggtctcgaagggttcgtaggaaaatatgggacctgggcgtatgcccggaatcgaattccgaggtccctagctcgagtaataaatttttattagaaattgttaaactgaaattctaaggatttaaagaaactaattaatgattgatcatgttggtattgggctcgtatgttggtttcgaactcattacaggtccaatataatatttaagacttgcccgcaaaatttagtgtcaatccgagtagtttaagggcgtttcggctcgttagaggaaaattaagagcttgaagttcataagttggatccaattgggtttagggagtgattcttagatttagcgttgtttcgggcgttccgaaggttcgagtaggtccgtttcatgatttcagatgggatacttactggttacatattgtttatgtactcatactacacttctgtacttaattatacagtgaggcaggtacatcttgctaccagtctggtgcgcgcccctaacttatagttcgagacttccacggtgagctgctccactcctgtgtcgttcagcagcttgatggagtctttctttgtttttgctgtatattctacctcagacagtatgatagttttattcttttgtaccttctactagttgcccattatttgtgacaccaggtcttggcacacacgttagtagactattatttgggggctgtataactattttggcacattactgttcattcctggtttagctttaacttaatgaattgctgcacttattttggtaaaagtaaaaaaatgagaacttatttatatttctgtgttggcttgcctgacaatggtatcaggcgtcatcacgatctattatggaaatgggccgtaacagtaagttacaagtttgtctagataatccagttaaatcgttcacgagagtgtcaaatggacgaatttgcctgaatttaaccgggttaaaacggattaaattaataaaggaatagattgtttacccgctcggttagacgtttgtcctattttcttattatatttaggtttcttatcttttgaaagaaggtcaatatatttaccacaattgattttacttttatgaaaaagaaaatatatttcttttatatttggctagttctttttcttggaagaaaaggtttttgagcatttataaattgaggattattccttctcatttaatagatgcacaatgtagtccctaaggggaagaatttttagacaagtgttagcccaccacttgtgtgtgcatcttattgaggttattctctcgatattttgtactctcttttatatagtggattgtttatcttctcctgtgaatgcaggtcaattgaccgaaccatgttaaatatttgtctctcttttgatacatttttcttttgttgtttgatttatcgtcgttcaaggtctgctttgttagcttccacgtgatatttgattatatttattttaacacgctcaaagattaattgaacagaggtatgatgaatcaaaacatactaaacaatagatcgtaagtcatagctcaacccgttcagattcgaatggatcatattttttatgcgcaaactttttgtgtcggtgacattaatttgccagagatcttgcttttcactcatatcccaagttatggaagctcgtgtttatcaaaatgcatcgaagtatggccatattggcatatgtaaactgactcatataaaaaattaattaagcaattaaacatgaaatattaatgttatttattttaaattggcaacatgaaacatgagtgagctatttttaactgactcatactgctaaattaaacattatgtttttttctctcaaataattagccaatcattcgatcaatttgttgaccgttgaacgacaagagtagaagggaatattttcttttatttaaaccatacaagataatgtatacttcctcaattcacttttacttattcactacaataaaaatatattttcacttttatttatccattttaataaattaagagaaattaagataattttttttcttgttgtacacttatcattaattactcattttcaaaattatttttcatgactctttgaaatgctatcattatgaggggttataaggtaaaatctgtactacaattattattttttaaggggcgtaaaaaatccaaaatgaacaattaaaaatgaacagagggagtacaaggcatcctatagctttttaaatttatttattactcctaatcctatcgttgtaaccaaaagaaaagaacaatacggaaagaacattaaagaagttatttttacataatatggagaagaaaaactgaagcagcttcagctgaatattttgcttatactcattcttctatacacaatggacaagatagaaaagaaatcccgagcatataatgcgggcatgttgatccatctcttcataatagtgcacctatcctttcaaaattctcaatccgcgtccgagtccacagcctttagtgatcacttcgttaattaattagtcccatgtgtggcggaataaggataataaaattgattgatgacgatagagattggagaagtcaaattcaacgtgagtcattgccaagaaataaaagggtaatcaagtcattgtcaatggatgttttactagtacttaagaaaactagttcacggggcaactaaacgatattccctcgtgcatggactttgccattctgtttattaatattttttctttttcacattctatttgttaatagtgttattgatttttttcgaaaattatgtttcactcacaaacaagacgctgtacaacacaaaacacatttcttttgttgatatttttttcatgatgaaaaatgatttcactagaccaaatgtatatatatgttgcccgcaatttaactgacacaaataattactactcccatcgtttcaatttatgtggctaataagtttgaattgtcacagaatttaagaagaattgaaaacttctaaattttatgacttaaaataaatcatagatatttatgtgattataagaccttctcattaagtgtaacatgaataatttgagttaagttcctttcagatttaaaaagttatcattctttttagaatgcattaagaaagaatgtgatcacacaaagtagttataacttgtaccaacagctctaatattttatgttgaacaagttagagttttaattttttttttctcatttatcctttgtaataattattttgaaaatggagatagcacataaatagaataaatatttaatgaagatagattatattttaagacattaataagggtaaaatagtattaaaaaaatttcttctagttaatgtttcttaagagttatgtaaaagagaaatacgatagataatttgagacggacggagtatatattgccccgcagtttaacagacacaaacaattactccctctgttgcagttcatgtggccaagtttgaattgccacggagtttaataaagaactgaacacttttgaaatttgtgacctaaaataaattatagatacttctatagttataaaagcttctcattgaacgtaaaatgaatttgagtaaaaaaaaaaatccaaatgtaagaagttaacattcttttggaatggatttagaaaaaaacctgatcacacaaattgaaatagagggaatagttataaattggaccaacagctctaatattttatgttgaacaagttggaattttaattaattcaggaaattcatgattggcacacctcattgggaagacataacggccatgtgcggagatctttcatgttggactcggattttatgtccctttctacttgtattcacattttgactctcgctatatgatgaaaaattgtcctctaacctcacaaagtcacaccagaaacaatagttctttggaaaagaagcaaactttaatattatcaagcagttaactacacttaacctaaaataattaggatgcttatttgatcattcaacgtaattatatctgatttactgtttttaaaaaaatctgatttactgttcatctaatataatagtacattcatttgaacatgaatttctgtgaagattccaactgacaatgcaagtgtaaattaatgttctgaacacgcttttgatatgctttcatatttttatttttaaggaaataaaaaatatttttctacataagaattattgccggtctcgagagagagtacgtcgttatgagaattaataatttatggcttgataattggcgacagagtcatgttcactttcattagtttataagtattagttgtacaatcgaaaataaaaaaattaagtattagagcatgaatatcacattttaaaagtaatcttttattatttttagaattaaacttaaaagcgtctattaatcattttgaactcataccccacgtggctcgtgatatgctatcaggtataatggcaaggtttcaatatatataaaggattcccccgttaggttacttcacaggggaaaaaaattgctaaattgtggcgatttatttatgaggtttaaaacatattatacattcgtgttacgatctggaattctcaccgtcggaaccgtgatggcgtctaatatttcacttgctaggcaagtcaacgttagaataatttattcatttttaacagtttaaatcaaataatgagaaagaacttaaatatctgaaataatccaaagtaaaaatgcggaagctaaaacaaccaaacttctaatacaaccctggacccggtgttacaagtgcacgagctactagaatagtacaaacaaaggtctaaaataacataaagttgttgaaaagaaagtacacatccaaataaaaagggaaggagactctaggagctgcgggcgctgagcagctgtacctcaagtctccacaagctgtccaatccgagtacgctaataaccgtcgttgggtctgactccaaaatctgcacaagaagtgcagattatagtatgagtacaaccgactccatgtactctgtaagtgtcgagcctagcctcgacgaagtaagtgacgaggctaaggcaggtcactcatactacaacctgtacgcagtatataataaatacataaaaggatatacggaatgaaataagacaatcaactgaaaataatggctatagccccaagaaataagccagtgatgttcagaattactaatccttatagtttcaaatgaaaataccgaaaaccaacacaaatcaaggaaatagaaacatatagcttgttgcggcacgcaatccgatctcaccatacaactcagaatcttcccttatttcactataacatcaacaataataaataatatatatgctgcggtgcgcgacccgatcccaccatatcacaatatcagtatcataattcacccttatattaccatatcagttcacctttattcaacatgttgcggcgtgcaattcggtcccaccgtatcagtacaagtttacccttattccaccatatcaatccatccttatttcacctgttgcgacgtgcaacatgatcccaccatatcagtaccaaatcctcaatgtgcataatcaaatcaataattcaaatcacaaggaccattatgatcaataaataccaagctgaaccaataagggaaccttgtacaacatgagaatttacacagataatattatataatgtaaatgacaataagaaggtgcaagtaagtcaattagggcaagtagcagtgaatcatgaaaatatgaaagggtctaacattattaatagaaaaaaacattaattaacaagtagcaaataagcagggaaagcatttagggtatataacaattaagacagggaaggagactatcatggaaaatcggaaaatcagggaaaacaattaattcgacggcgtataagcactcgtcaccgcgcatatacaccgcagcacatgaaatacacatagcacatagtctgaggattcctaattccctcaaatcaaggttaaacttaacacttatctcactctgcagtcaatttagagctctaccggggcctttaccctagaatccacctccaaaccacttgtatctaagcacaattgactcaatagtatcaaatattgctaaaggaatcaattacaatgcataaatttagaattcccacactttttccaaaaaaatcaaaaatcaacctcgggtccgtttggtacaaatctaaaattcggcccaaaactcgattacccattcacccccgaggcctttagataatttgtttcgaaatccgacctcaatttgaggtctaaattccaattttgcaaatatccctaattctacccaaacccccaattttcaccatgaaaatcctagattttaggttgaaaacttatgaatggaagattgaaagaaaataagttggaatcacttaccaatgaattggggaataagagttcttgggaaaattgcctctagggttttctagttttgaaaatttgaagaatgaacaaaaatcccgtctaactcaacttttacacagttgcagatgtcgcaattacgaactcctctcagaatcccagttatcacatttgagataaaatagtcgcaaatgcgaatcctgatgccttcacaaatgtggacctttcttcgcaaatgcgaagatcattacaaaatgtgctgagtcgcaaatacaaatctgccttcgcaaaagcggaaatggaatgttcgcaaatgcgaactttcacctcacaaatgcgagtacccccctcccctcgctgccgccgccatgaccaggctcgtaaatgcgatggtttcttcacaaatacaaggctcgcaaatacgagccaaatctcgcatggtttcttcacaatgcgagatctgcagtagacaccagaaactaactgcatcagctatgtttctaagcccaaactcacctcgtcgcctattcgaaactcatccgagccctcgggtctccaaactaaacatgcacacaagtccaaaaatattatacggacttgctctcgcgatcaattcgccaaaataatacctagaactatgaatcggacaccaaaatcaaatgaatttttaagaaaactttagaattgctattttaacaaccggatgtccgagtcacgtcaaaccaattccgtttctcaccaaatttgatagagaagtcataaatatagtaatgaacctatactgggttatagaactaaaatacggatccgacatcaacaaaatcaaacatcggttaattcttaaaaatcattaaacctttgaactttcaattttcgacaaaaatcaataactcgagctagggacctccgaatttgattccggacatacgcccatgtcccaaatcacgatacggacccaccgggatcgtcaaaatatggataccagtccatttgctcaaaacattgacgaagtcaactcaaataaattttaaggtaaattttcgtgttttatcagtttttaacataaaagcctttcagaaaaatactcgaactgcgagcgcaaatcgaggaaggcttaaagaagctattggaggcttcgaaacacagaattacgttctaagactctagatgagctaccggatcatcacattctcaacctctaaaacaaccattcgtccttgaacggacatagaaaagtacctgagttggtgaaaaggcgtggatatctactttgcatgtccgactcagacttcaaagtagctacctccaccggccggcctctccactgcactcgagctgaaggataactcttagaactcaaccatcgaacctgccaggctagaatagccaccaactcttcctcgtaaatcaaatccttgtccaactggactgagttgaaatctagcacatggtaggatcaccgtgatacttccgaagcatggacacatggaacaccagatggaatgctgataaactaggtggcaatgcaagcatgtaagccacatctcccactgtctcaagaatctcaaaaggtccgatatacctagggctcaacttgcccttctttccgaactccatcacaccctttatgggtgaaacccggagcaataccctctctccaaccatgaatgcaacatcaagaaccttacggtcggcttaactcttctgcctatattgagctgtgcgaagacgatccttaataatcttgaccttatccaaggcatcctgtacccaacaaccgagcccccccccccccccccccccggtctcgaaccacccaaatggcgaacggtaccacctcccgtataatgcctctgtaacgatccaagttctccctccgtgaactgtcgtgatggcacctagtctctacgactaggtaagcctaatattgtggaaatgaaatgaaaacacaaagataataactaacaaatatagttaataagcagaaacgatgcttctcggcatataaaataatcactttttcacaaacccagaatgtcacaatgtcacaagcttctaagagtttctaactgcgctatacatttatgtctgaagaaaacaaatgggaaaatcaacacaaggggatagaaggtgactccgagatctgtgcatgcagcagatgtaccttgaagtctcttgaagcagctaccatgcaactagactcgaggccgatagctagtacctggaattgcacacggaaaacatgtgcaggaaacgacatgagtataccacaacggtacccagtatgtgccaagcctaacctcggtcgagtagtgacgagatcaggtcagagccctactagtataaatataataaaataagacagaaagaagtattacaatgaaataagtatgaaaatctaacagaaacggaaatcaatgaaaaccgatagctcagaatacaataataacaataggggatctcccgggataccatcccgtagtcccaaacgtaaatgtgcaaggggatctcccagaataccattctgtagttccaaagtaaagatgcagtataggagatcacccgcaataccgtttcgtagtcccaaattaaatatgcatctcaatcaatataaacaacagttacagtaaagaaacctatagatttgactggttcacatcaaataagacaggtattttcactaaacatgctacacagagttcaaataggtagttaaaacacgtaagcatgcttttctaatctaaaaaggtagttacatatgctagtgtagttcaaaacaaggagaaacaggttatgacttagtgaaaaacaaagttttacaacaaagagcccgtgtacatactcgttacctcacgtacacgacgctcatatatcaaacagtaccgaatcctaaggggagttcccccacacaaggttaggtaagctacttaactcgaatcaagctcaaatcaatctgaaacaatgctctttccacgaatatccggctccggatggcccaaatctagccaaatcaattacataatataaatatagctacaagtaactaatttagctaatgaaatcaaagctaaggcaagaaaacaaaaaaatgcgcaaaaaacctcctctggcccacatcttggaatcgggtaaaagtcacaaattataaacactcattcactcatgagtctaaccatacaaaattcacacaaatccaataccaaaatctcaatcaaaaccccaaaattcggcctaataacttttctcaaatttttccaattttccaccccaaatccgaaattaaatgatgaaatcaagcatagattagtgggatataatcataaatgagttaggaataattacccataaatttccttcgaaaatctctccaaatttcgccttctaccgaactctcaataaaattttgtgttatgaactcagaccctcattttttgaactataaatctgcccaggtacgcccttctttgcgaacacgaccaccacctcgcgttcgtgtagaacaaaagtctactgctcaatttttcctcttttgcgaacgtaagtttcctcttgtgaacttgtagcttcagctgccaggaccttcgggaatgcgaccccttgttcgcgaacgcaaagatcaaattcctaaggtcccagctgttccattttctctacgcgaacgtgatgccattcacgcatttgcgatgcattgtagtccaaaccttcacgaacgcgtccccttattcgcaaacacgaagggcattttcttcttcttccccaactcctcttcgcgaatgcgggcttcttttcacgaacgcgaagaacaaatctctgcaacaaaaaccagcaaaaatctgctatccttctaagtccaaaaatgacccgttgagtatccaaaacacacccgagaccccgggacctcaaccaaacttaccaaccaatcctaaaataccatacgaacttcgtagagccctcaaatcatatcaaacaacgctaaaatcatgaatcactctccaatccaaactttaagaacttgaaacttcaaaattctacaacttatgccgaaaccaaccaaaccatgttagattgaccccaaattttgtacacaagtaatattcaacactacggacatactacaacttccggaatctgattccgtccctgatatcaaaaattccactaccgacccaaaactccaaaaattcgactttcgtcatttcaagcctaaataagctagtgacctccgaaatacagtccggacatgcccctaatccaaaaatcacccaacagagctaacagaatcagcggaactacttttcggagtcatctttacatagttccaactacggtccaaatcctaaagcttaaaccttcatttagggactaaacgtcccaaaacacttcaaaaatcaaaacgaatcttcccggcaagtcacaatagtagaaataggtacgggggaagcaattaataggggattggagcattaactctcaaaacgaccagccggatcgttacattctcccctcttaaaataattgttcgttctcaaacgagtatagagacatacctgaagtggtgaaaaaatgaggataacggctgcgcatgtcctgctcggtctcccaagtcgcctcctcgaccggctgaccccgccactgaaccttcactgatgcaatgttctttgacctcaactttcgaacctgcctatccacaatagccactggctcctcaacataggatagatccttgtctaactggactgaactgaaatcaaatacgtgagacggatcgccgtgatacttccgaagcatcgaaacatgtaatccaaatggactcctgctaggctgggaggtaaggcaagctcataattaacctctcttacacgttgcaacacctcaaaaggaccaataaacgttgggctcaacttgcctttctttctgaacctcataacacctttcataggcaaaacctagagtaagacccgctctccgaccatgaatgccacattgtgaatcttccgatccgtataactcttatgactggactgggctgtacgaagtctatcctgaatcaccttaaccttctccaaggcatcctgaaccaagtttgtacccaataatctagcctctcccggctcgaaccaacctactggggaccgacaccgcctagcatacaaagcctcattaggtgccatctaaatgttggactaataactattgttgtaggcgaacccctcaaagggaaagaacttatccctagaacctccaaactccatcacacacgcacggagcatatcccaagaatttgaatagtgcgtttggactgcccatccgtttgagggtgaaatattatgctaaactccaccggagtacccaattcttattgtacgtctctccataaccgtgatgtaaactacatgccccggtcagagatgatagataccagcatgccatgaagtctgacaatctcacggataaactagagccaactgcttggaagaatatgtagtcatcataagaaggaaatgagctgtcttggtcagtctatccacaatcacccaagctgcatcaaacttccgctgagtccatgggagtccaaaaacaaaatctatagtgatcctctcccactttcactccggaatctctaacttttgaagcaatccacctggtcactttagaagttaccaacgaaataaattgccggtaagtgaagtatgagcatcagcgaccaggtgggtttctttagaaattagagattccagagtgaaagtgggagcggatcattgtagatttcatttttggactctcatggacgtagcggagattgatgcagtttgggtgattgtggatagactgaccaagttagctcattttcttcctatgatgactacctattcttctgatcagttggctcgagtttatatccatgagattatcagacttcatggcgtgccgatatctatcatctctgaccgaggcacacagtttacatcaatattctggagagccgtacagaaagaattaggtactcgggtggagttgagcacaaaattttaccctcagacgaatgggcagtctaagcgcactattccgatttttaaggatatgctttgtgcgtgtgtgatggagtttaaaggttattgagataagttcttgccccttgcggagttcgcctacaacaactgttattagtccaacattcagatggcactgtatgaagctttgtatggtaggcggtgtcggtccccagtgggttggttcgagccggacgaggccagattattgggtacagacttggttcaggatgccttggagaaggttaaggtgatcaggatagacttcgtacaacctagtcatgacagaagagttatgcggaccggaagcttcgcaatgtggcattcatggtcggagagcaggtcttgctctgggttttgcctataaaaggcgttataaggttcgaaaagaagggtaagctaagcccaaggtttattggtcattttgaggtgttgcggtgtgtcggggaggttactaatgagcttgccttacttcccagcctagcagaagtccatccagtatttcatatttcgatgctccaaaagtatcacggcgatccatctcacgtgttggatttcagttcagtccagttggacaaggatctatcctatgttaaggagccagtggctattgtggataggcaggttcgaaaactgaggtcaaagaatattgcatcagtgaaggttcaatagcggggttagccggtcgaggagagctacttgggagaccgaacaggatatgcacaaccgttatccttatcttttcaccacttcaggtatgtctctatactcgttcgaggatgaacgattcttttgagagggggaggatgtaacgatccctacggtcgttttaaaagttagagacccaaaccccgattaattgcttcctccgtacctatttctgctattgtcgggaagattggttttggtttttgaagtgttttgggacacttagtccctaaatggaggtttaagctttaggatttggattgtagttggaactatgttaatacgactccgaaatgtagttatgtcaatttctttagctccgttgggcgattttgggcttagaggcatgtccggactatgtattggaggttcatagcttatctaggcttgaaatggcgaaagtcaaatttttggagttttaggtcggtagtggaatttttgttatcgatgtcggaatctaatttcggagttttgagtaggtctgtagtgtttactatgacttgtgtgcaaaatttggggtcaatcggacgtagtttggttggtttcggcatcggttgcagaattttgaagtttcaagttcttaaagtttggattggagggttattcatgatttagcgttgtttgatgtaatttaagggctcttgtaagtttgtatggtgttttaggattggttggtaagttcgattgaggtcccggtagcctcgggagtgtttcggatgttcaacatgtcatttttggacttagaaggatagcagattttttttggtttttgttgcagatatttgtctttcgcgttcacgaagagaagcccacgttcacgaagaagagttggggaagaagaagaaaatgcccttcgcgttcacaaataataggacgcgtttgcgaaggtttggaattcaatgtatcgcaaaggcaagaatggcatcgcattcgcgtagagaaaatggaacagctgggacctcgggaatttgttcttcgcgttcgctaacaaggggtcgcgttcgtgaaggtcctggcagctgaagctacgccttcataagagggaactcgcattcgcgaaagaggaaaaattaagcagtggacttttgttctacgcaaacacaaggtggtggtcgcttttaggaagaatggcgtacctgggcagatttaaagttcaaaaaatgagggtttgagttcataacacaaaatttgattgagagctcggtagaaggcaaaatttggggagattttcggaggaagtttgtaggtaatgattcctaaatactttatgattatatcccactaatttatgcttgatttcatcatttaatttcggatttggggtggaaaattgggaaaatttgagaaaagttcttagggcgaattttggtgttttgattgagattttggtatcggatttgagtggatttggtatggttagactcgtgagtgaatgggtgttcataatttgtgacttttacccaattcttcgacgtggggccgggaggctttttgggcatttttctattttcttgccttagctttgatttcattagttaaattagttatttttagctatatttacattatttaatttatttggctagatttgggccatccggagccagatattcatggaaagagcattgtttcggactgatttgagcttggttcgaggtaagtagactgcctaaccttgtgtggggaactccccttaggacttggtactgtttgatatatgagtgtcgtgtacgtgatgtaacgagtacgtacattggctatttgttttaaaactccgtttttcactaagtcataacatgtttttccttgtttttaactacactagcatatgtaactaccttgtttagattagaaaaacttgcctacgtattttaactgcctatttgaacttattgtagcatgtttagtggagttacctatctttttttatgtgcacttagtcaaatctgtaggtttctttgttgtaactgttgtttatattgattgagctgcatatttactttaggactacggaacggtgttttgagagatcccctgtactgcatatttactttgggactacagaatggtcttccgagagatccccctacacatttacgtttaggactacggaatagtatcccgggagatcccctgttgttattactgtgttctgagctatcggttttcattgaattccattcctattagatttttgtacttatttcactgtaatacttctttctatcttattttattatatttatactagtagggctctgacctgatctcgtcactactcgatcgaggttaggtttggcacttacttggtacagttgtggtgtactcatgccctttcatgcacatatttttcgtgtgcagatccatgtactagctatcagcctcgagtctagttgtgtggttgttgcttcaggagacttcaaggtacatctgttgcgtctacagttctcggagtccccttctatccccttgtgttgattttccccttgttttcttcagacataaatgtatagagcagttagaaactcttagatgcttgtgacattgcgatatttcgggttttgggaaaagtgattattgtatatgccgagcgacatcatttctgcttattaactatattctttggttattatctttgtgtttccatttcatttccgcaatattaggcttacctagttgtagaaactaggtgccttcatgacagttcacggagggagaacttgggttgtgacagcctcataacaagccatctgaatgctcgacttgtagctattgtggtaggcaaactctgcaagtggcaagaacttatcccaagaacctctgaagtctataacacaagcgcagagcatatcctccaatatcttaataatgcgctcgaactctccgtccgtctgaggatgatatgttgtgctcaacttaacctgcatgcccaactcacgttgtactgctgataagtagggattttgactacttatttgcatctttttacttgcgttttagctcaaaaatgcttaaaggtattcccgagaactgataaaatgtgcttacttgtaggattattggaaaatgagccaaagagataaaaattaactcaagaaggagtaattttggacaaggactaaaacaaagcaaaaaagagcaaagtacagaccacacaatattgtgtgcggccccagagcatgaagagacctctgatggattttctttgcaaagtgcggaccgcacaataagacctctgatggattttctttgcaaagtgcggaccgcacaattattgtgcggccgcagaagatgaggttcagagagatgtgattttggaccatgaagaagtgctgaccgcactattattatgtggcagcactaattatgcggccacagaaatccatcctgtcaagccagtttcaaagtgcgaacagtacacagaattttgcgtccgcagaaccttcacaagggaatttcgtccgataatttcaggtgtatataaatagtcttttttgtcaaaattagcttatgttttgaacatctgaaaatagatagccgttttccctttactgttttgggtaactatgtagtagtttatcattttaacatttgattttgttccctttatcatttattatgagtttaatcttattttcttctttagtttcttcaattttctctaagagtagctaaatttctagctagggttgtgacccaatcctagtgtgggtacctaatgggtgtttgaattagggcttgtttgtcattggattagtgatatttagcatagttctcccttgaatttaagaattaatggttgcaaacattgattcatgcataattgacttagtctctacttgagaaagagagactaaggctaggaaaacttggctaacaaggaattagggtgaactcagaaaattgattgcccaattaaagggttgaatctagagatagtaagacccgacttgagcatttatcacttgttttgtgcaacacctatttgaacttgagaaagccaaattgggcaaaaccactctaactaccgagaggtaatgagtgggtaactgcgtgtgattgctatattacgactctgaccaatcaaacttgtcatagagcctacaatctgttaggtaaccatataggtggaagtcacgaccctagatcttttataaacttgaaaaacaacaacatcaaaaatatcgatctctagattttcatttgcagatattagcataatcattagaagtataaagaaacaaccaaacatgtggaagtgcattttgggcacatcatacacttagtcttgatatatatctaatccaatataaactctctatggaatcgacctcgacacacgttgggtaattataatttcatcaaccgcttcacaatcccaattagtggtgtgaatttgggcgacatcaatttttggcgtcgttatcggggagctaaaaacggatttagctatatatctgattttgtgtgtgatttgtcttcttttacttccaagttactaatcatttcgtgaaataattgtaggtgatacaatggctttcaacaacaatgatccttttggaaatgtgccattggggggataacagggatgatgaccaagttgatgaggttctttttgaacctcaagtaaatagacgaggccgcccgcctcaagacaatgttcccgttccacctccacctcctccaagagcggcggtacaccgggtgttgtcgaatgaaggatatgcaagtgccatagtcctgccccgcattagggcggaaaacttttaaataaaaaatggcatgcttacactattggaacaacggggattctccaccggggctccgagtaaaaatacgtacaagcacttgaaagggtttgttgacacttgctggaggagtaaacaaaccaacgtctctaaggatgctttgcgattgaggctattctctttctctctgcgggggaaggctttgaattagttggagaagttgccaactcattctatccatacatgggatgaattagctgagaaattcatttccaagttattttctcccgggcatatggcaactcttagggatgagattctagatttcaaacaagaacccaatgagcctttgcatgagatatggggaaggtaccgtactatggtgaaagagtgcccaatgacatgatggaggctatgatttaacaaaatttttatagggggatcaatactactaatcaatgtgtggtcaactaaattgctggtggaaatttcctgacaacgtcgtatgcggaagcttgtgagattcttgatgaaatggcggatacttcatcggcatggcaaagtagagctaacgttcctcaaggtgatgcaaatgtgattcatttgcataaagaattacatgatcatggaaagcaactgccgagttgaccaccacaataaatcaactagccaaagctcaacttcaacaagtgcaaggtcccaagaaattaaatgcaatggaaggagtaagtatgatggtaaacaagagaaggcaaaagagtcctcaagtacaaaatcgggttgagaagatgatagtggatttgatcaatatggacaatacaatgattaagaagaggaagtacaatatgtgaaaaacttccaatggcaaataaacaataatcaaggcccaagttaacagcaatggcgaccacgagaaaatcaaggaaattagaattcaagcaatcaaggtggttggaacaatcaaaacaaccaaggaaattggaacaatcaaggaaattggaatggtcaaaataatcaaggcaattagagtggcaataatcaaggcgattagggaggtaacaaccaagaagggtggaactacaacaacaatcgggggtcgggttttcaaaggcctccgatgtttcaacaaccgatcaatccacctccatatccttctaaaggtcctatttcttctaacaataagatgggccgaatagagaacatgttcaaacaaatgctggagaaaaatgccgactccgatgctcaattagcctttcacaacacttcaattttcaatttggaagttcaattgggccaaatctcacaagctttgaacactcatcctaagggtgcactaccaagtgatacggtggtgaacccgaagggtgggaacaacacgggacatgccatggccgtgactacaaggagcgaaaaaggtggggaaacaaccacctcaagtcaaaagaaaattgtggatgaggaacaattggtacaagaagatgagatgccaagcaatgaagtgaaagcaaatgatgaggtgagaattgatattgatgacaatgtggaggagactcaagaagaagtgaacccgtctagggagcatatgttgacataccaaaatcggtattgccaaaggctaaggaaccaataccaaggccttcgcctccatatcctcaaaggcttgccaagcaaaatggttagaactaataaaaagttcattcacatgatgaagaacttgtctattaatgtaccgttggttgaggccttggagcaaatggtgggttatgcaaagttcataaaggactcgatgacaaagaaaagatcgatgaattatgagactataaagatgacacatcaagtgagtgtaattgtgcactcaatggctccaaaattggaagatccgggcgttttcacaatcccatgtacaattggaagtgccgactttgccaaagctttatatgatcttggggtgagtatcgacttgatgccctattcggtgttttctttggggattgggaaactaagatccatatccatgagattgcaaatggtggatcgtataatgaagagacctttgggtattattgatgatgtgttggttcgtgatgacaagttcatcctcccggcggactttgtgattcttgattgtgaagtggactataaggtgcctattattttgggttgaccttttctttctacaaggaatatttgttgatgtggaagctggtgagctcactttccgggtgggtgatgaaaaggtggtcttccatgtatgcaaatctatgaggcaaccaaagagcaatgaagtttgttcgttcgtggatttggttactgatgtgattattgatgatgctagtaccacaatgaatgttgaggataatttggaagtcatttttctcaaccttgataatgatgaggagaaagaaagctatgtggaatgtgtgaatgcattgcaaggaattgggtcgtacacttatgaaccccgcaagttatccttagatctttaaaattggaagactcctccaacaaagccctcaatcgaggagcctcccactttggagttaaagccattgcctctgcatctcaggtatgaattccttggcctttcttctactttattggttattttttcctcttgtttgactaacatacaggtagactccacattggaggtgatacaaaggaggaagagagcaattggatagacattggcggatattcggggcatacacctcttcttttgcatgcacaagattattttggaggggggtgccaaacccttcgttgaacatcaaaggaggctaaatgaagcaatgcaagaggtggtaaaaaagtagatcataaagtggttggatgccggggttgtttgccccattttcgatagttcatgtacttctccggtgcaatgtgcccgaaacaaaaggggcattactgtggttaacaatgataagaacgagttgattcctacaagaacggtgaccagatggacagtatatatggactatcgcaacctcaacaaagtcacaagaaaagatcattttccacttcccttcctcgatcaaatacttgataagttggcaggccgtgctttctattgtttcctcaatgggtattctgagtacaatcaaattcttattgctccggaggatcaagaaaagactactttcacatgtctatatggtacttttgcattgtcacggatgccatttgggttatgcaatgcaccgacaacttttcaacagtatatgatggctaacttcaccaacatggtggaggatattcttgaggtcttcatggatgacttttccgtggttgggaattcttttaatgattgcttgaacaatttggataaggtcttggcaaaatgtgaggagacgaacttggtactgaattgggagaaatgtcacttcatggtcgaggaaggcattttcctcggccataaaatttcaaataacggtattgaggttgacaaagccaaaataaaggtgatttctaaacttctgcccctatatccgtgaagggagtgagaagtttcttgggtcatgcgaggttctatcgccgattcatcaagaatttttccaaagtggtaaaccctttatgtaagcttttggagaaggatgccaaatttcatttatgaggattgcatgaaggcatttgaattgctcaatttgaaattgacaactactcatattatcactgcacctgattggagcttgccttttgagctcatgtgtaacgcaattgatgtggcggttggagcagtcttggggaagagaatcaataaaatcttccttccagtctactatgctagtaagaccatgaatgattcccaagtcaattacacagtgaccgaaaaagagctgcttgttattgtttttgctatggagaagttccgcccatacttgatgggtacaaaggtgatcgtccacatcgatcatacagcgctttgatacttaataagcaagaaagattcaaaagagaggttaatgtggtgggtgcttctattgcaagagtttgatctagagatacaagaccgcaaaggtagtgaaaatcaagtggcggaccacttgtctcgattagaggaggaggggaggccacacgatggcctagagatcaatgattccttccccaatgagcagcttctagctatttcaatgactaggatgccatggttcgccgactttgaaaattatcttgtgagtggcattgtatcgaatgagttctcttcaaaccaaaggaagaagctcaaacgggattgccttgactattattggtgtcacacctcctttttccgcccccgcgaggggtgaaggagtttttccaattaaaggacaatcgaaacgggatttgttcgtttatttcagagtcgccacttgggagatttagggtgtcccaagtcaccaatttaatcccgaatcgaggaaaagaatgactctgtattacagtccgcgaaccagaaatccggataaggaattttgttaacctgggagaaggtgttaattcccgagttccgtggttctagcacggtcgctcaactgtcatattcggcttgattatctgattgtatataaatatgaacttatgtgcagattttaactctttaccgctttcattattattattattatcttacagggaattgcaacgttgtgaaaatgttcctcgaaccgcgtcacaatcaatgtacccgtggtcgtcgacacactttgactccgttgagatttggatttgggtcacataaatgtgcacccgagtttaagaagataacattattaaatacgtgcctaaagcgattagagtattattattttaggaaaggccgcggagttcgctaagcggcctatcccgagttctaagtaattaacacatacattttttgtgagggccccgcaatctgtgcattttatttggcgaggctcgtctcatttttatttaaaaggtcgtcctatagtggctatgttttctattttgtttgcatctaaaataaatgaaaacgtcctactttatttacatacctatgagttattatagttaagtttcgaacgtgatttgttgaaagagggacgtgatacgagcagtccatttggcagttatggacccaggcccagcacacactgtatggactggacctgggccattccttttccgataagggcctgttaattcatttgactcaggcccaacatttataaggctgaaatgggaaccggtgttattttattctaacggtattgttgcaatttataacgaggcaacctactaaatgaagtgagattaactaacaatggatagttcagcacttaacatgcgttagaagatatgctaaccataaacatagctaaaattcaagatattgcttactacactatcagcttttttgtctaccagcatacatacacagtatgatattaagttgccatacatgacgtttagttatacatgatggctaccttcattatcctaatagaagatgtgaactattatacacaacttaatgttcaatatacagactatgtatgattcaaaaatacaacttcaactcttccttttttgtattcatgtttcaactttcagcttacattgacagtgtatcagtggtgtacctggtattgagaaaagcaaaagaagaaaggaatgatcagtggaagcagtagcatatacagcaacagcagcaacaagagaagcagcactcagcagcaaacaacccagccggcagatgtttaaaaccaatacaaatccagcaagaaaatccaataataaccagtaggaggaaacaacaacagatttaaaccaagcagaagaccagtgaactatcagaccaacagaaaacccaaaacaactcagctgaaatagtgttcaatcaagtatttgcagcccagcagcatcaaaacaaatacaggctaacagagaaggaaacagatgcagaaaagcagtagtttctgattgttatggtcaaaaaactagcacactcttaactctttattactttgaaacagactatcctctaaaggttggaagaccaaccttgtttttgcttttcttttctctctcacttaaaactgtccagcctctaaacttaactgtccagccttaaaaccaattttttcctttccttccagaattaatcctttctccaaaaaaaatcctctttcaaacacctcaatgagcctgtttaaaggccagcaatggcaagcccacaggctgccttcccactctgcccatacccccttaaactaatcaattatgcccatgatattcctgacagactccccataccgcatgcttttctcttttttaatcaaagttatgggtgtttaacttattttaatcaacctcccccatgccatttaatcttgttccccactattgcattagtttaatcctatttcagtaccctattgtcagcccaacttaaactaaacatgtttggtcttttcaaacccccaaactaccccttttaaaccttgattattactgtattaccctactgcaacagtaggacattttgaacttctgaaagttcaaattcaaagcttccctaaactgagttctagttattgcgttgtagttacaaaccattcacaaataatgtcaaacaagccgatagacgacaatgatatccatcatatgaagctataagaatcagaatatttgaacattcagtcctgtaaaactaatcgacgacatttatctaatcgactatactaattataacatagaacaaacagtcgaccaaacaatcaacataaataaggcatcaactgtctttgacaattttgcacgacacagggaaactacaggcattatcgatttgacgatattaatcaaatttaaatatgtatatcactatacgtattcaaccataaacagaataacaatcgacagaataaaaggtcttatgaagatgggggacaaattggaaaaaaaaatatcagaaataccaaataaaccaaacaaacatgctgacaaacccaaacaacatttaaacaaaaacagaagagagaaaaggaactcactctggaaactcaaacacagacgacccaagcccggactggatttgcccatttgaggtcgaacaaaccttaatcgaggtgttctcaaccgagaacacttcgattaaattctatgagaccccaaccctttgttatactggccggattccaaggttcttgtgttctagagttcgaaccagtccgatttagggcttgaggatttgtgggtagatttggaccaaaccaagcttggtttggtcacgagtgagggcagtgtaatggttggtatgaatccggggtgggttggtgtagatcgggattttgctcgaacctgctaatgaagattcgagacgatagggactgattcgaacccaacggtttgcagatccgtgttctgggtggttgggtgcatcaagggtgttactttgggtggccaccggcatcgtttcctccgggctcatggtgagagtgtacgggggcggctagggtttggaacaagggtttggtttgtgtttgggacgatagaagggggggtgttcggataggggcgtggggtaaaggtttaggcttatatacgtagtaggtggttagatcctggcctttggatgaagtgagatcgatggccaggatctttcacttaatggggaacgacaccgtttggcattggtttggggggtcggtttgaatcggttactgggtcgggtttggaaacgggttgttgaaaggggttttggactgttggattggactggatggaaggctcagatcaaattccctatgcggcgtcgtttgggtaagtgaatggcctgatctggaccgttcatttgaatcaatcaatggctcaggatggggatgctgatacagcgtcgtttggggcgtgcctgggaagcctgggtttggactgggttgtggtaattggtttgggcctgattttttcatttaaattttggcccaaatccggtattttccttctttacaattagacaaaaattcctaaaaaccaaaattaaacacacaagtattaattaatacctaacaacaattatcacatgaattaaaacatctaataaagttaccctgacaacaaaatagaagaacaatgcatattttgtgattttcgcttttaaaaccaaatcatggttaattaattcgtaaatgtaccattttccctaaatgcatgcaacatttcttttttgtatttaactatagcaaagcgagcatttacggacaaaacaattatcaaaaaatattacacaaatccccaaaattgtacccgaaagtaacctgttttatttcttttccgatttcttttggagtagttttctgtgaagcaaaaatcacgtgctcacagctgcccctctttggccgaaaacacaaagagttttcgtgcaaagataaagtgagcggatacgagcgattttttcccgttggaatactccgtgtgaagcattttttggaaaaagatttaaccgaacctttgcttcaaaggtttcctacatatccctggctataggggaatcaggttaatgtagttcgggaagttttggtagctgggactaccatgggactgcaatgttgctgatgttgcatgctgttatcactgcttaccgatctccttgttaccccgtgcttaaaagaaaacaagaagctaggctagactacggatcataagatctcatctatcttcaacttgttcttgttgccttgctttcttgttggcttgtatttcttctggtgcttttcttccgtgaatttggggatgacactggccttttgcttttctgaataccaattttcatcattttgttcggtccgctggggatatggcttccttcattaagctttgttatgctgggcataatttaatgttcacaggccgcttccttcgagacgcatcctttcttccttttgactcatgggcttgaatttgcgctgggacatcttgttgcaaccttctactttccggtgctggggaattttattgtttcctgctggggattcctgttgcaaccttctgccttccggcgggttactgatttcaagatctgcggtataagactgaaaagtattcctctcattatacaggtgggcgcctacttaactaagacgtgaaaatattcctctcattatacaggtgggtgcctatttaactaaaacatgaaaatattcctctcattatacaggtgggcacctatttaactaagacatgaaaatattcctctcattatacaggtgggcgcctatttaactaagacatgaaagtattcctctcattatacaggtgggcgcttatttaactaagacatgaaaatattcctctcattatacaggtgggcgcctatttaactaaggcatgaaagtattcctctcattttacaggtgggcgcctatttaactaagacatgaaagtattcctctcattatacaggtgggcgcctatttaactaagacatgaaaatattcctctcattatacaggtgggcgcctatttaactaagacatgaaaatattcctctcattatacaggtgggcgcctatttaactaagacatgaaaatattcctctcactatacaggtgggcgcctatttaactaagacatgaaaatattcctctcactatacaggtgggcgcctatttaactaagacatgaaaatattcctctcactatacaggtgggcgcctatttaactaagacatgaaaatattcctctcattatacaggtgggcgcctatttaactaagacatgaaaatattgaatttgtttcctcgttcctccgagaaagtttttgataatggcaagaattttctgccggtcttggtgaccttccttgtggtgtgtctttctgtcatcctcatctttttttttcctgtagaatcaaagaaaatcttgttagttttaacatggtgagtgattcgtgtcactcctgctgggggatgactttccatttatccctttccctttcccttgctctgcgctcccaaaactggttgggatgaagttgcttgctggggatggtatgtctgctggggatggttttccgtttatcccttcctcgctcttttgttttgaaacaagttgtgggagtccctttcaactccaaaactactcccttaaaagtttattttatcccggccggcggattaattctctcttcctccttccccctttatgtggtgtattaccatctcggaccttggtccgtgatctgtcgcagttcttgctggggatcttttggaacttggtccacaaatccttcaactgtcgttttcttcatgttccccttatctttctaagctaatttgtcgccttccgtcctattgccttggttttggcctgtgcccttcgcattttgctttgtaccattttggcccctggtagtaaactctgaaaagtccttctcaaaacaaatttctggaaaagtcttttagacaaagagacgaaaaagatagaaaagagaaaaaatctttctgaacaaatgctggggggaagaagaaaaggaaagaacttatctgggtggtatgactggtccctacgatcatgtcgtgcattacggattacccgacctagtctatttgtatcaatcaatttttctgatggccttatttgccggggatgaataggttcccacctcttcgcaaatgtggatccttttgccaatctgccttgccgccttatagttcccttcgagaggttttcactaataagactctctctttttctctcacctcccgtcgccttacggtgcctgtgaaggttttcaccgataagactctctcgttttatctctctcgtctttcatcgccttatggtgcatgcgaaggttttcacaaattaagactctctcattttatctttcaacgggggattggagtgttgccgatatgactctctctttcggagattcttttcggccatcaactcattgccagtttatgaccctcttctttgctggagattagcgtattattctcggcttccattggcctgacttggtacctctcagatattgatcgggatcgatgttggttttgtgtgtcaaatttttaacgtaactttgatgggtgaaatgttacaactcttggaatcaaaccctttttggagattcaaaaaaaaaactcctgccccagttttcttgcttggggaattttatatttacactatgttgagctatgcctattatgcacactatgcacactatggtgcactatgaccgagccgtgaggcgcctacgtatcctctttgaggaatcagatcaaacgtagttcctacgttcctttgtttttcttatgatctttatcttgttttcatttttcttttaatttattttctttttttcatatctttttcccattagtgattccaaaagaggggtatgaaagaataactaaggctcaaaggggggaagcaaaggttaaaagtgtttggatagagaaaagaattgcctccgtcatttcattatccaataagtaccaaatacaaacaaacgaaccaataactaccataattaaagaaattacgcataatatcttttgactgcatcagaattgatatccatgtcgacacatcttccctcgatatctgttagacacaaagcaccgttggacaatactctggtcacgatataaggcccttgccaatttggggcgaacttgcctattgcttcgacctgatgcgggaggatccgtttcaatacttgctgccctacttcaaattttctggggcgcaccttcttattgtatgctcttgccattcttttctgatacaactggccatgacacactgctgccaatcttttttcatctattaagttcagctgctctagtcgagctttgaaccattcatcgttatcaatcccggcttcagcgacaattcggagggatggaatttcaacctccgccagtattactgcttcagttctgtataccaacaaataagaagttgcacctatggaagtccagactatagtgcgataacccaacaaagcaaagggtagtttctcgtgccattgtctagattcttccaccatcttccgcagtatcttcttgatgttcttattggctgcttcgaccattccatttgccttgggacgatatggggtggaatagcggtgtgtaatcttaaattgttggcatatcactctcatcagatttctgttaagatttgcaccattatccgtgatgatcacttttgggaccccaaatctgcagatgatatgggagtgaataaaatccaccactgccttcttagttaccgacttaaaagttttagcttcaacccacttggtgaagtagtcgatggtcaccagaatgaacatatggccgttggttgctgctggcttaataggcccaatgacatccatcccccatgcgaaaaatggccatggtgctgacattgtatgcaattctgtcggcggagaatgaatcagatctccatgtatctgacactgatggcatttcctcacgaagttgatacaatcatgctccatagtgaaccaatagtaccctgctcgaagaatcttctttgccaatacatatcctctcatatgtggcccacaaactccagcatgcacctctgccataactgtcgtggcttgaccagcgtctatacattttagcaatcccaagtctggggttcttctgtacaacactcctccaatgaggaagaaaccatttgacaaacaccaaagggctcttttttggtccccagtggcctgctccgaatatatccccatcttgaggtactcctttatgtcataaaaccatggctcgccatctacttcctcctgtaccgcgttgcaataagcatgctgatcgcgaacctgaatgtgcgacgggtcaacatacattttttcgggatggtgtaacattgatgctaaagtggccaatgcatcggcaacctcattatgaactctcgggatatgtctgaattccactgatcgaaatcgcttggtcagatcgtgcaaacattatcgatatggtatgagtttcaaatcccgtgtttcccactcaccctgaatttgatgcaccaggaggtccgagtctcccaagaccaaacttcctggacatccatgtctgcagctagtcgcagacccaaaatgcatgcttcatactcggccatgttgttggtacaatagaagcgtagctgagctgtaacaggataatgacgtcctgtttcagaaatgagtactgctcctattccaacccctttcgcgtttgcggctccatcaaagaaaagcttccagcttggttcctcgggtaattccatctcacctgtgtgcattacttcctcgtctgggaaatacgtcctcaaaggctcgtattcttcatcaacgggattctcagccaagtgatcgaccagcgcttgggctttcatggccgtcctcgtcacgtagacgatatcaaactctgtgagcaaaatttgccattttgctaacctccctgtaggcataggtttctggaaaatatactttaatgggtccaaacgggagatgagataagtagtatacgaagacaagtagtgcttcaacttctgagccacccaagttagggcgcaacatgtcctctcgagttgagtgtacttgacctcatacactgtgaacttcttgctaagataataaatggcctgctccttccttcctgtaacgtcgtgttgccctagcacgcaaccaaacgaattctccaggaccgtcagataaagaattaatggcatccctggctcaggtggaatggacagataccctttaatttggttgaaagcctcttgacactctgccgtccagtctaccgcggcgtctttctttagcagccgaaatatgggttcacaagtcatcgtgagttgagcgatgaacctgctgatgtaatttagtctccccaacagactcattacctctgttttgttctttggcagtggtaaatcttggatggatttgatcttggatggatccaattaaataccccgtcaactgacgatgaatcctaacagctttcctgatggaaccccaaaggcgcatttggccgggttgagcttaatatcataccttcgaagtctttgaaaaaatctccttaggtctgctacatggtcttcctgacgccaagactttatgatcacatcatctacgtacacttcaatttctttgtgtattatgtcgtgaaacacagtagtcattgctcgcatgtacattgccccagcattcttcagtccgaatggcattacccggtagcagtaagttccccatggtgtaatgaaagctgtcttttccgcatcttcttcgtccattaagatctgatgatatcctgcatagcagtccacaaaggatccgatctcgcgcccagcgcaattattgatcaggatatggatgttgggcaatggataattatccttaggacttgctttgttgagattgcggtagtcgacgcataccctgattttcccatccttcttcggcactggtaccacattggccaaccaatcgggatatcgagtgacccaaataaccttcgcctgcagctgcttaatcacctcttctttgatcttcacactcatctctgttttaaatttcctcagcttttgcttgaccggagggtataccgggtcagtgggcaatttgtgaaccactagattggtacttaatcccggcatatcatcatatgaccacgcaaaaacatctttgaactccatgagggttttgattaattcctccctgacgtttggctcaatgtggatgctgattttggtttctctgacattatctgcgtcccctagattcacagcctcggtgtcattcagattaggcttgggtttctcttcaaattggcacagttctcggtttatttcttcgaaggcttcatcctcgtcatattcaaactcatcgtcataaccgatctcttgtataattaagttggagtcagattgatttattagactaggtcgaagatccgctgtgcatgccatgtcattagaaccagtaaaaagagaactgttcagaaagaaaaagaacaaaacaaaattaaaatgagacaagagaagagaattttattaaatttgcgagataacagggttcacacttttacaaaacaaaatgagatttcgattacaccctggaataatccgaaacaagaaagcaaaaatcaaagcctactaccaggactccccccggataggaagaggagtaaccgtccaattgttggttttggccccaggccccacgaactgtatgtctgccctgctggaaccctctccaacttctaccatattgacattagcgaacagcctttcgaaactctgattcaaatccccgtccatcccaatcaatggtccgagaatttttgggaccggtgaccccttggcacttgctctaataaaggatcttgagagacgcggtatcagtttgggaagaaaccaaactctcttctttgttttctgcgctcgctttacatctgccgcagtcggtttgaaccccggtccaaaggtctccaaattcttgggcaaggagacaggttggacaatcccctgaagatcagccccaggccttttcccggcacaaacccattacccaacatttctgaaaccatcatgaccgttgcggaagctaccctagggtgctgaatgatctcaccctcgaaaatcttgtttgccgatactgcatcaaaaatctggtaaacccaggggcctttgtcatcattggtttctatgaagggcacaatggcgcctcccatagtgcacgcagtgtcctcgccgtgcagtacgatctcttgtctatcccactcgaacttgaccatttgatgcaaggtggatggcactgttttagctgcatggatccacggtcgtcccaacagaaggttataagataccgcggcatctaatatctggaactccatggtaaactggaccggaccgatggttaactcaagtataatatcccccacggtggctgttccatttccatcaaatcctcggacgcaaatgttgttcttgtggattcttctgtggtcgatcttcaactggcttagggtggacaatggacaaatattggcacttgagccgttatccaccaatgcccgagtaactgccgaatcttcacatttgacaattaagtagagagctctattatgttccgtgccctccactggcaggtcatcatctgagaatgttaccctattcacctcaaaaattttattggcaatcgtttcaaggtggtttacagaaatctcgttgggcacatgagctttatttagtatcttcatcagggcccgacgatgttcatctgaatggatcagtaatgataacagcgagatctggtccggtgttttcttcaactgttcgaccacggagtaatcctgcactttcatcttcttcaagaattcctcagcttcttcttctgacacaggtttctttgttgcagctgggttgggtcttctcaactccactggagcaaaacaccgtcctgatcgagtcagtccctgcgcctcacaactttcctcctccacttgttttcccctgtacatcaccactgccttctcatacttccaaggaacgacctttctatccatcattggcaattggactaccgactttatggtgaccagttccctgtatacccctttcaacacaactgcgggtgtgggtggtgtccctgatattaccaatttggctggctttggtttctttgttgcggtggacggactctttcccaatatcactactggcttgacacctttcccttgcaactgtacctctagtcttacaccggtcgattcttctttcggagcggcttggattgtcatcactgcctgtgatggttttattggctctcctccctcgtataccaactcgatcttgtgagcttcgtggtgtactggcaatgggttctggttgatgttgggcgcctccggtgcctggacctcgattttgttggcatcaataagatcttgtattgcctgcttcagcctctaacatttttcagtatcatgccccagcattcctgagcagtactcgcagcttatcgatcggtccaaattttggggctaggggttttgctctctaggttcgacaggactcaccaaacctagctgtctcaatttgtggaatacggcggtataggtctctcccaactcagtaaaggctttatgtctctgtagcctgtcatttctagcagcttgactccctcgaaagcccgcccccggagggttcctgtatgctcttggtggaggataggtgctttgtggtggagggtaggtgttttgtggtggtgcatatgtgttctagggagccggtacgcgccattgcgggcgaaccggaggctgaaggtatgtttgggcttggtgcacggagaagtggggttcttgaggtggatagtagtgttgtggtgggctgtatgggtagtttggcctatgagggctgggtcggttgtagtatggtttgccggacctagaccaattgcttgcctcaaccgtggcgatttcttctttcttcctccttcccaacacacctcccatgccgctctgaatagcctgggtcgttgccttgagagctgagtaattcatgattttgtcagacctcagaccctcctctattatgacccctatctttactactttattgaaggattttccaaccgtcgtcaccaagtggatccagtgtttgcaagaagtagtccaccctttctccctctctcatgggaggatcaactctggctgcctgttctctccagcggaaaccaaactcactaaagctttccccaggcttctttccggtcctcagcaatgtgagacggtcagggactatctcgatattgtattgaaagtgacccgcgaaagcctgcgctagatcatcccaagtgtaccatctgctggaatcctgcctggtataccattccaatgtcgatccactcaagctttgaccgaaataagctatcagcagctcatctttgccgcctgcccctctcattttgctacaaaagccccgcaaatgtgccatgggatcaccgtgcccttcatacaaatcaaacttaggtatcttgaacccagccgggagttggacgtccgggaaagggcatagatccttgtaggccacgctgacctggttgcccaatccatgcaggttcctgaaggattgctccaggattttgaacttcctcattacctcatcttgctctgggaccttaaccggcttttcaatctccgctagtacctccaagtgcggattgtaggtatggggttctggtgcattgaatgtgggttcagggggatagtattgcgtttgagcctgaaacaacggctcgctggttgatctttgcagggtggctgatgtgggtcccataaaagtgggaacatttggtgttgggagaggttgatggggtggtggagcttgggaatcatgggggcttctctcctgatgatagcggtgattcgggaggcttgttgaagggccagagtgagggtattccggcatatgccctagtggttcagggctcttttgtgctttggccaaagctaactgcattgcattcatctctagtcccatcatttctatcttctccttcgcttctttcaacatctggcttactggcctttcttcctcggtactattttctgaagtagtcatgctcgttgttaccggtcctttggatctggtttgataagggtgtgttgccagaatgcgttaacaactaactgtctggtattgagaaaagcaacaaacttattagcgttagagtttaacagatttgataatagcacattggggatgcaatgctcctaggcagcaaaccatttctaacatgctttgcttcaaacacatgcgtcatcccggcttgattatttgcccctttaaagtactttgggaacccctgtatttctttccatttttttcttctttttttctctttttttcttttcctttctttttaatggcggtcgaatcttatgtggattgcctacgtatcacgtccccgcgtgaatcagaccgggcgtagttctgccacaaagtaaagacacaaaaattcttttggaatcattcaattcatcacccaaaatttgctattgcaaattacttatctcaaacaaagaacagcaatagtacagattccaaagttcttaacctgaatcgatgaaaagaaaaagaaaacaacatatgggaagacaacaaagccaataaacaagactcgaacaagggattaaaattccaacttaggggctcgcgaggcatcgttcggcctttccgcagactttgatgtgaggcctttctgcaagctcttcaactcattcatgatccggtggacgtagcccatgatggaagcaaggaggtattccgaggtatttgctcacacgataggcatctcatgtagatgtagtgcccaatctcatcaatccttcctcgaatgttgtccctctcaacgaacaattgctctattcgccggttctttaatcctagtgcttgagcattgtcggcgagtcgatcctggaacttctccatttgtctttccattctggtcatcacatcgtaacagcgccttctgtcagcttgggcatctcgtgcttgtttgaagatccgctcctgaagagtggaatttgttttccttaatatcccgatgctcatttcagaatcccttatgatttgttgcagatgctttctacgggccattgtaccttttgcccatctgacctttattcttgctatgcaagcttccgatctctctagttcttcttggcttttgctgacttgatttcccaattctgctatcaatctttcgtcggagcgacgtttctgtcggtcattgttactcttactgacttggcgaacgcgggcttttagtgtctggttttctttggctaatttgttcttttcaccttgctcagaggcgacttgcacgttgttctcaaatataagcctttcaacttgttgctttagcctcccgatttcagcctggtagtcttggatgtgagctctcttagttggtctgtggtgctcaagctctcttctgtaccacgtgaggtattttggcgacacttcgcccttggcccgatcttgtacacaagtatttactttcagggtttgacattcattccagattctccgaacgactgcttcagggaactgcccaccaggcccgatttcgaccacctggctactgagatcctcttccttcgggattatttgacatcgccccaactgcctcaatactctgtttggcgcataaggctggatactttggagacccattaacaacaaatgagactcgatggctgacatgtgtatgacctcatctatgggtagccacccaaatgcccattctatctggtttgctgaaacagagcgcagtagagtaacccattcggcgaccccttctggcaagctgaacccgtcgaccctggtggaaaactcttctatacaagtctttcgtgatgacccatattttagaaattgagggcgatgacatagatgctctatcatccacatttgcagtagtatattgcatccctcaaagaaacctcctccggttttgcaaacagtgagtgcgcggaaaatgtctgctattatcattggtgccagagtgttgttgtcttgcttgagcaaagtgctgacgaccccaacgatttgtatgttaattttcccatcctttctagggaacaccggaaaacccagaaaggctatcataaaagcaatacacctatgtctttcccatttcagctggctttccccactgcagatcttactctcgggattgttgaaccctccaagatgaccgtacctgtcgtacagaaatgccaaactacaaaacccttatgacaactctgggttgtgtaccgttctgtggatctttacggtatctacgaatctgtgtatggtcacggtccttggtgcaatgagatactattctctcatagggattttaggacatccgatgtaccctgccatctcctctagcgtcggggtgagctcaaagtccgagaaatgaaatacattgtgtgtcgagtcccaaaatgaaattaaatcccttataatgtcccctcgcggatcgatgtccagcaatccaaccaaatttcctaagtatattttgactgtatctcgccctgattcttacaagtcgtttcaccacatgcgtaagcccaaagggactctgtttataatggccccatatgaactcttactcgtgctcattctgcacatttattaaggtgatttagacgaaagcaaaaatctttattttgactccaaaaccatttttcccgttttccttaatttttgagaaaagcaagactgactttcccaatatggcctttcagctcttcaggggtgaagattttaaggcagtgggattttaaccgtccaaaaggtaagaaaaatggccaaaggcggccgttggtgcaagacaaccttccgacgtccctttcgggaacattcggctatttccgcaaaatggcatcacccgactcttttatgaaagaagcaatatatgtatatatatatatatatacatatatatatatatatatatatatatatatatatatatatatattatttgcaaaaataggaagttggacccgataagggttgcctacgtatcccacatccggtgagaatcaaaccgacgtagttcgggtaagaaaattagctaaatcacgaatccaattctctttcctcaaaaatcaaaattatttggacattggtttttctcaaatgagcagctcttaatttttcaaaattcccgttatcacccaccggtcaacatgcaagttcgaagcaaattaaatgcgccaacagacaatatgcaacaagatggtcttttttgttccagtttgctattcctagacgggcccaacccctgtgttgagccccctaagtcagatgcaacgtgatgcaaataagtgttttcctactagggatccggcatgaagtcatgttttactaagtttcaaactgggctttgttctagacctggcttacccgagcggacaactcgagtcgaggagggggctacgtaccggggacccgcgggatcgtccggctttgtaacttgtccggcctttttcttatttcaaggtatgacactaacagaatagggagtctcgaccagcgagcttctccccggaggtaagaagagaagggtttcggcacagattatatacagttcaaataatatcaaagcggtaatacacattattttgcacatgaagcacatatctcataaaaatatcagataaatctaaacataacaatttattctaagctcgatttctaaccctgaaccagtggttctgggtctatttatccccagcagagtcgccagagctgtcacacctcctttttccgcccccgcgaggggtgaaagagtttttccaattaaaggacaattgaaacgagatttgttcgtttatttcagagtcgccacttaggagatttagggtgtcccaagtcaccaatttaatcccgaatcgaggaaaagaataactctgtattacagtccgcgaaccagaaatccggataaggaattctgttaacccgggtgaaggtgttaggcattcccgagttccatggttctagcacagtcgctcaactatcatattcggcttgattatctgattgtatataaatatgaacttatgtgcagattttaactctttaccgcttttattattattattattattattatcttacagggaattgcaacattgtgaaaatgtgcctcgaaccgcgtcacaatcaatgtacccgtggtcgtcgacacactttgactccgttgagatttggatttgggtcacataaatgtgcacccgagtttaagaagataacattattaaatacgcgcctaaagcgattagcgtattattattttgggtaaggccatggagttcgctaagcggcctatcccgagttctaagtaattaacacatacattttttgtgaggaccccgcaataggtgcattttatttggcgaggctcgtctcatttttatttaaaaggtcgtcctatagtggctttgttttctattttgtttgcatctaaaataaatgaaaacgtcctactttatttacatacctatgagttattatagttaagtttcaaatgtgatttgttgaaagagggacgtgatacgagcagtccgtttggcagttatgggcccaggcccagcgcacactgtatggactggacctgggccattccttttccgataagggcctgttaattcatttgactcaggcccaacatttataaggctgaaatgggaaccggtgttattttattctaacggtattgttgcaatttataatgaggcagcctactaaatgaagtgagattaactaacaatggatagttcagcacttaacatgcgttagaagatatgctaactataaacatagataaaattcaagatattgcttactacactatcagtttttttgtctaccagcatacatacacagtatgatattaagttgccatacatgacgtttagttatacatgatggctaccttcattatcctaatagaagatgtgaactattatacacaacttaatgttcaatatacagactatgtatgattcaaaaaaacaacttcaactcttccttttttgtattcatgtttcaactttcagcttacattgacagtgtatcagtggtgtacctggtattgagaaaagcaaaagaagaaaagaatgatcagtggaagcagtagcatacacagcaatagcagcaacaagagaagcagtactcagcagcaaacaacccagccggcagatgtttaaaaccaatacaaatcaagcaagaaaatccaataataaccagtaggaggaaacaacaacagatttaaaccaagaagaagaccagtgaactatcagaccaacagaaaacccaaaacaacttagctgaaatagcgttcaatcaagtatttgcagcccagcagcatcaaaacaaatacaggctaatagagaaggaaacagatgcaaaaaagcagtagcttctgattgttatggtcaaaaaaccagcacactcttaactatttattactctgaaacagactatcctctaaaggttggaagaccaaccttgttttttcttttcttttctctctcacttaaaactgtccaacctctaaacttaactgtccagccttaaaaccatttttttcctttccttccagaattaatcctttctccaaaaaaaatcctctttcaaacagtcctcaatgagcctatttataggccagcaatggcaagccctaggctgccttcccactctgcccatacccccttaaactaatcaattatacccatgatattcctgacaaactccccataccgcatgtttttctcttttttaatcaaagttatgggtgtttaacttattttaatcaacctcccccatgccatttaatcttgttccccactattgcattagtttaatcctatatcagttccctattgtcagcccaacttaaactaaacatttctggtcttttcaaacccccaaactacccctgttaaaccctgattattattgtattaccctactgcagcagtaggacattttgaacttctgaaagttcaaattcaaagcttccctaaactgagttctagttattgcattgtagttacaaaccattcacagataatgtcaaacaatccgatagacgacaatgattcgatccatcatatgaagctatacgaatcagaatatttgaacattcagtcctataaaactaatcgacgacatttatctaatcgactatactaattataacatagaacaaacagtcgaccaaacaatcaacataaataaggcatcaactgtctttgacaattttgcacgacacagggaaactacaggcattatcgatttgacgatattaatcaaattgaaatatgtatatcactatacgtattcaaccataaacaaaataacaatcgaccgaataaaaggtcttatgaagatgggggacaaattggaaaaacaaaatatcagaaataccaaataaaccaaacaaacatgctgacaaacccaaacaacatttaaacaaaaacagaagagagaaagggaactcactctggaaactcaaacacagacgacccaagaccggactggatttgcccatttgaggtcgaacagaccttaatcgaggtgttctcaaccgagaacacttcgattaaagtctattagaccccaaccctctgttatactggccggattccaaggttcttgtgttctagggttcgaaccagtccgatttggggcttgaggatttgtgggtagattcggaccaaaccaagcttggtttggtcacgagtgagggcagggtaatggttggtatgaatccggggtgggtttgtgtagatcggggttttgctcgaaccttctaatgaagattcgagacgatagggactgattcgaacccaacggtttgcagatccgtgtttagggtggttgggtgcatcaagggtgttactttgggtggccaccggcatcgttgcctccaggctcatggtgagagtgtacgggggcggctagggtttggaacgggggtttgggtttgtgtttgggacgatggaagggggggtgttcggataggggcgtggggtaaaggtttaggcttatatacgtagtaggtggttagatcctggccgttggatgaagtgagatcgatggcaggatctttcacttaatggggaatggcaccgtttggcattggtttggggggtcggtttgaatcggttactgggtcgggtttggaaacgggttgctgaaaggggtcttggaccgttggattggactggatggaaggctcagatcaaatgccctatgcggcgtcgtttgggtaagtgaatggcctgatctggaccgttcattcgaatcaatcaatggctcaggatagggatgctgatacggcatcgtttggggcgtgcctgtgaagcctgggtttggactgggttgtggtaattggtttgggcctgattttttcatttaaattttggcccaaatccggtattttccttctttacaattagacaaaaattcctaaaaaccaaaattaaacacacaagtattaattaatacctaacaacaattatcacatgaattaaaacatctaataaagttaccctgataacaaaatagaagaacaatgcaattttgtgattttcgcttttaaaaccaaatcatggttaattaattcgtaaatgtaccattttccctaaatgcatgcaacatgtatttttttgtatttaaatatatcaaagcgagcatttacggatgaaacaattatcaaaaaatattacacaaatccccaaaattgtacccgaaggtaacctgttttatttcttttccaatttcttttggagtagtttgttgtgaagcaaaaatcacgtgctcaccattgggatgaaccgtatcttttacggatatgtaccgatggtgtgatccgatgatgtgtgccagaggaagaacaagtggaaattcttgaggcttgccactcttcaacgtatggtggtcaccatggcggagctggaacggccacaaaagtgttgagttgtggattctattggtctactctctataaggatgctagtggtctggtcaagcattgtgatgaatgtcaaagggccggtgggatttttaaaaagaatgagatgcccctcaccatcttggaaattgacatcttatatgtgtggggcattgatttcatgggactgtttgtgagctcttgtgggaacacttacattttggtagttgtggactatgtgtcaaaatgggttgaaaccttggctttacccaacaacgaagcttgaagtgtggtggcatttttgaagaagaacatctttacaagatttggtactccaagggctatcataagtgataggggttcgcatttgtgcaataaggcttttgataccttactcaccaagtatggtgtcactcacaaagtctcaaccccctatcatcctcaagcaagcggacaagtaaaagtcattaaccggagatcaagagtattatatcaaagacagtgaatgccaaccagacagattggtcaagaaaacttgatgatgctttatggacttatagtacggcttacaaaacaccgactgggatatctccatatcgattggtgtttgggaaggtttgtcatcttctggtggaacttgagcataaggccatgtgggcactgaagaagttgaaccttgagtgggatgtcgtcgcgaacttaagggtggcacaattgaatgagcttgatgaattctggtaccatgcctaaacaatcttgtctctattcaaggagaagatgaagcacatccatgacaagtacattcgaaataaggaattcaaagaaggtgatcttgtgttattattcaactctcggttgcgaatgtttcccagcaagttgaagtcaaaatagagtggcccgtttgatgttgttcttatgacaccattcagagcattggacttaaaaaataagaatgatgaagtgtttagagtcaatgggcgtcgggtgaagcactatcttggaaaagttgatgatggccacatcgtggcggttcttcatttcaagtgattggtaatttgtgtcgtgccgcgacgttatattaggcgcttcttgagaggcaacccatgtgtctttttcttttttcttttctttttcattagatagtctttgttttgtgctaactagttttgaagggtatgcaggaatgggtatgcattgcagggactggatcataaaaattggctaagtgttgaaaaagtgtggaccgcacattaattgtgcacaccgtgcaattctgattgcaacagcagaaatcactctatgtccacacaatactatgtgtggtcgcacaactggaggacaaaaattgcaagctctctgaagttggtctgtcaaaattcatagccaatctgcggccgtacacaaaattttgcggcccgcacaaattctgtggcctaattcacttttgtgcggactgcactcaaaattgtgtggccgcactcagcttaagtttggggcgacttggtcaacctatatattgaaccttagtgcactattcacaactttatacaactctgagttcttgagacctaagaaagcacaatgcacatcgaattagctcacactcctcactcatttcatctatgtagattattacctgcatcattcatcactggtatgttcattacatctttagatttttcaatttctcttagttttcattcttctgtggaagagtattcttagacctaaaatgtctaatgtcattcatgtgggtagtatcatatgtgttcattggggactgggtagatcattaatcatgtttcattgcaactacaatgtctcaattgtgtaaaaaaattgcaaaacataaagtcagtggtacgtgatttcttattgtgcatccgcacataaaattgtgcggtccgtagatcttagaattagagcaaatgtgttgcatgaaaagtgcggaccgcactcaaaattgtgtggtccgtggaaaagtgtgggtgaccgcattgttaaaggatcagagaaccagtactctgaacctgagattgtgcggccgtactcaaaattatgggttccgcacatcagatgtgcgaccgcactttaaaattgtgtggttcgcacatggcagtctgcgaccactctcatttttgtgcggtccgcactgtctctcctgtggtctgttttcctacaactgtaatgcaactgtttccacttatttgaaatccaactgacttatatacctcatattgcaaacaatggtttgatcacgaggaagaggtgatacttctaaagggaagggtgaaccctcccgaggccgaggtagggacaacctcccactctcagtccaaacagaaataagcaaaaaggcaactgccaacagagtccctgaaccctcaaaatgcattgtgtatctcctgtctagggaagcctcagaggaaaactctgtgcaagcataacctgatgcctaatctcaatccaaacaagttcagggtagactacaattgagagacgaatcctcctcctctgctagttcttctgagggttcggaagagggtagccaagattttgagccctcttcctcaaatagcccagcaacaccaatccctattgatgatgatgatgatgatcctaaagatagtagatggggtgacactagagtgggaggcctaaagaggtcgaagaagaaggaggcatgcgaatatcgatttgtgagtttgacagccttcactaggtttagagaatggtggacccaaagataactcacacttgagtggcaattcttagtgaaggatttggataaataaaatccaaatgtccttcagcagttcagggagcgcaaggggtggatgtggttcaccaagagtgtcgtggacgccaaggagcacttggtacgtgaagtttatgccaatgtagcacgcatcaagaaaggtaccaaagtgaccaaagtaagaaatttgaaagtcagatttgatcaatgtactatgaacacctatatgggatttgaggaggtagaggtagttcagtatatggagaagcttacaatgggtgatgcagctcgcccttaggtagtagagatcttagcagctctaggaccactaccaccatggatcacatcgggagctcccattgcacaaaacacccttaattctgaagcaaaagggtagaaaacttttgtgtgcggccggatagacccgagcagaaatgagaacaatattccacttcctcgagcagttctagtagcatctatcatgggcgggtacccaaacaatgtgggtgctatcatgtcggccaacatatcagtggttttctgaaagagtgaaagctcttatccatatccaatcaccctcactaaatactttaaggatgccaaggtggagctgaggagatttgatacacaggtgcaggccaaaaatcccttctcatggtactctctgcaaggacccaggaacccaaaattcaagggtaaagtagctaccaccaatggccagtctgatgagccaacgatggtggttacagattcttctgctgagccctttacaactaccatgcctttcgtagtagtcgatccttctatcaagacatctgacatgctaccacctccatcttctagaccatctacattagtacctgtgcctacctcatccatatatccactcattaagctgcgagtctcccagaaattggcgagtctcaacaactgaatgcagacagctacttcaaagttgtctgatatatctagtgctattgtagcacagtcttctaccctagcagcatcacaggtacctccgtcagtggaggaaacattgtcaaagatcctggaaaatcatatgaccattatggatacattggtggcacatgggacagtcattgaggagttgggcaaatcggtgaagaagatgcaaaaatctcaagcttcgaagaagtcaatggatagattaagaaaagaagttaccaagatagcatctgctgaagatataccacttgatttgcttatggagtcagcactagcagcacctgcagcaccagcaacaccatcagtgtcggagccatcagaggcagcagctggccaatttaaggagccaaaccttgtttcccacactactgaggagatgttgcagatgttctcaaaccctgttattccctggccgaaggatgatgagatccagttggcggagtccgaggatgatgatgaccctatgcacactgagaccatatagggagttctcttaactctctacccttttcttattctgattgttatgaagcattgaggacaatgcttgttcttattcaggagggtggtctattttgattgatttaatatgagattggatgtaataactttaatactctttttcttttatctttattctctttttcattttgtatatattcctccctctcttttgatgtatatattttattcccctcagtttgtattttcatttgtcttactttcagtagtttattttatagcttttctagtttgtttgtcttagtagtataacttcttatttactctaatagcttctttttgatttggtagcttctttttatgtttaagtgagcaataagactttggtttttttaatgtcacgattctttccaaaggtgggttttgtgtgaaccgggtgacttttcccaacgatggatggcgtgacaaccttcttaagggactgagtccattttttatgtttaggtaaaaataatagtattaatgaataaaacgggacatgcatgcttcacttggtaccaacacatttaacaatggtcttatgcttaaaaacaagtcttggcaagaaataactttaattagtgacctatagactcttgtattgacttgagcaatcatcgagtggtttagttgaaccattagcgattttcaatcttgaatatggttgttgtgggccctcgactctatcctctttaacattccaatcgtgtgagaagtgatatttttgtagcaagtacaagtacccgtacgaatggtctagaacttgccccgaatgtatttctaggagaaattctaagttttgcttggcttgagaagtgattgtaggctctccttgatgcacttgaaattttccatgtcccaccaatgttgcaatccctagtcaacccatttaagcctaagacctttctcatttgatagccacgttacaagcacttacccattttgtaatgaccttctcttggcaccctagctttccttatcactcttgagttatcactcttgagaagtaattggctaaaacataagttcgggggagagacaaggaggttgaaagtggtaagaaggcacaaaaagaaaagaaatgaagaaaaagataggcaaagaaaaagaaagaatgaacaaaagaaaaatgtaaaaagaaattgaataaagtaaagagttgaagggattcaaagaaaagcaatgatgcaaatcatggagaaaacaaagaaggagaaaattaccatcttggccgaaaaagagtgatgttaagtctctctagttcccccaaggaaaaagaaaatgactcatagagtcgacaaagtatgagccaaaaagagaaaatggagtatttaagggaagatgaacccattctattccagcaaatcctatcttagtccaaagccttcattacatcccgaaaatgccctacatgatttcaagtcgagtgagcttatattagaggcaagcatatggtacctagagccgtacttgtgacattcttttgagagagatgagcgaacttttcaaaaatccttgaattgagtgctacattcttaagtgagatatgctaacggagagtagaggatgaggagtttgggatccattatgacctacatgaaagagcgagcttccttgatgaataaagtcaactctcgatgctctagtgtcatatttgaactattgtatttggaaagtccaatcgttgccttgttgaaaattcataggtgttgtgggtaattattggtcccaattgatgtgtgtttgattcaccttaggctagctgaaatagatcttttcttgtggaggtgggaattaccttatttgcttgaggacaagcaaaagcttaagtttgggggagttgataagtagggattttgactacttatttgcaccattttacgtgttttagctcaaaaatacttaaaggtattcccgagaactgataaaatgtacttacttgcaggattattggaaaatgagccaaagagataaaaatcaactcaacaaggagtaattttttataaggactaaaacaaagcaaaaaaaagagcaaagtgtggatcgcacaatattgtgtgaggctgcaggcatgaagagacctataatgaattttctttgcaaagtgcggaccgaacaattattgtgcggctgcagaagatgaggttcagagagatgtgattttggaccatgaagaagtgcggactgcactattattgtgtggctgcagaatcaaaagagcggccacactcataaatgtgcggaccacagaagtctcccatgtcaaagctcaaagtcaagagtgcggccgcactcaaaaatgtgtggtctgcagaatttaaagaagtgcagccgcaacccaaaattatgcaaccgcagaagtctatcctgtcaagccagtttcaaagtgcagaccttcacaggggcaattttgtttgataatttcagttgtgtataaatagtctttttggttaaaattaggttaagttttgaacacctaaaaataaatagccgtttttcctttactgctttgggtcactttgtagtagtttatcattttaacattggattttcttccctttatcatttattatgagtttaatcttattttcttctttagtttcttcaattttctctatgagtaactaaatttctagctagggttctgacccagccctagtgtgggtacctaatgggtgtttgaattagggcttgtgtgtgattgggctagtgatatttagcttagttcttgcttgaatttaagaattaatggttgcaagaattgattcatacctaattgacttagtctctacttgagaaagagagattaagtctaggaaaacttggctaacaaggaactggggtgaactcaagaaattgatagccccaattaaagggttgaatctagtgatagtaagacccaacttgagcatttatcacttgttttatgcaatgcctatttggacttaagaaagacaaattgggcaaaaccactctaaataccgagaggtattgagtgggtaattgcgtgtgattgctatattacgaccccgaccaatcaaacttgccctagagcctacaatccgttaggtaaccacctaggtggaagtcacgatcctagatattttataaacttgaaaaacaacaacaccaaaaatatcattctctagctttttatttgcaaatattagcataatcattagaagtagaaaaaacaaccaaacatgtggaagtgcattttgggaacatcatacacttagtctagatatatacctaatccaatataatctatttgtagaattgaccccgactcacgttgggtaattataattgcatcgaccgcttcacaatcccaattagtggtgtaaattgggcgatatcaactgccctctagaaatgcgaggtgaactgcgtacctcaatcagaaatgatagacacgggcacaccgtgaagaagaacgatctcgcggatgtaaatctaagccaaccactctgaagaataggtaactgccatagaaatgaaatgcgctaacttggtcagcctatccacaattacccaaactgcatcaaactttctctgagtccgtgggagtccaacaacaaaatccatagtgatatgctcccacttccactgaggaatctctatcttctgaagcaaaccaccaggtctctgatgctcatactttacttgctaacaatttagacactaagctacatatgcaactatatcgttcttcatcctccttcaccaataatgattccgcaagtcctgatacatcttggcggcacccagatgaatagaataccgggaaccatgggcttcctcaagaatcaactcacgaagtccatatacattgggcaaacaaacacgaccctgcattctaaaaacttcatcatctccaatagtaacctacttggaacctctgtgttgcactgtgtctctaagaacaagcaaatgagggttaccatattgatgctccctgatgcgctcaaacaaggaagaccgaacgactgtactagctagaacacgcctaggctctgaaacatccaacctcatgaactgattggctaaatcctaaaaatctgatgcaagtggtctctcaccgactggaatgtatgcaaggctgcccatactcactacctttctactcaaggcatcggctactctattggccttcccgggataatacaaaatggtgatatcatagtcattcaatagctccaaccacctcctttatctcaaattgagctccttttgtttgaacaagtactgtaagatttgatgatccgtgaatacctcacacgacatgctgtaaagatagtgtcgtcaaatcttttgcgcatgaacaatggctgccaacttcaagtcatgaaaagggtaatttttctcgtgaaccttcagttaccgcgccacatatgcattcacattgccatcctacatcaataccgtaccaagtccaatacgagatgcatcacaatataccgtgtaagatcttgaacctatgggcaacaccaacaacggcgtcatagtcaaaacagtcttgagcttctgaaagctcgcctcacactcgtctgactatctgaatggggaacccttttgggtcaacctgatcaatagggctgctatagatgaaaactcctccatgaaccgacggtaataacccgccaaacccaagaaacttcgaatctccgtagctgaaatgggtctaggaaagttctgaactgcctcaatcttcttaggatccactagaatcccatctgtcgatactacgtaccccaagaaagtgaccgagtccaaccaaaactcgaattttggaaacttagcatgtaactatttgtctctcaaagtctgaagtgcgattcaaagatgttgctcatgctcctctcagctacgggagtagatcaagatatcatcaataaacacgatcaaaaaggaattcaaatagggcttgaacacccggttcatcaaatccatgaatgttgttggggcattttttagcccaaatgatatcacagaaactcatgatgcccatactgagtccaaaatgttgtcttagggacattggatgccctaatcctcaactgacagtagccataccccaaatcaatctttgaaaacaccttggaatcctgaagctgatcaaataagccgtcaatcttcggcaatagatacttgttcttgatggtgactttgtttaactaccgataatctatgcacatcctcatcgatccatccttcttcttcacaaaaaacacaggagcacccccagggcgagacactaggtctaatgaagcctttatcaagtaagtcttgcaactgttccttcaactctttcaactctggcggggccatatggtatggtggaatagaaatgggctgaatgtccggagccaagtaaatatagtagataatatccatgtcgggtggcatccccagcagatttgcaagaaacaccaatggaaactcgtaaacaactggtactgaatccatagggggacctccgcactagaatcgcggatataagccaaataagttagacacccctttttgaccatatgttgatccttcacataagagataaccctattggtagaatggtcggagtccctctccaccctaatcgaggaaaccccagcaaggctaaggtcaccaacttggcatggcaatccaatatagcatgataaggtgacagccaatccatacctaaaatgatatcaaaattaaccatatcgaaaagtagaagatctacaggagtctcaagactcccaatagtaaacataaatgaatattagacatgatctacaataatagaatctcgtacaggtgtggacacatacattggagcactcaaagaatcacaaggcacaactagctatgaagcaaaataggatgacacgtaggaataagtagagcccaaatcaaatagaactgaagcatctctatggaaaactgaaataatacatgtgataacagcgtctgatgactcagcctcaggcctagctgggaaaacataacatcggggctgggccccaccaatctaaactacatccctaggatagcctctagctggttggcctccacctctagcagtctgacctctacttctagtggcctaacctccacctctggctgcttgaccccttcctctagctggctgagcgggcggtagtgcaaccggtgtcagaatcatggcacgataactctgctatggtgtgcctcccaataatctcggacatgtcctcctgatatgcctaaaactaccacactcaaaacatccatcctagtgctatggttgctaaaattgagattgacccgcacaagctagataaccatggtaataactctgaataggaggtgcactgataggagttgacggtgcacaataggctggcttcccagaatgaggcacataaggaccacgactccctgaagcactgtgggatgcctgaagcgctaactgaaatcgcctgagaggatggcccctaccaaaagtacccctgcctccagatgaggcaccgctaaaaccaccagaatgatgaggcctcttatcaggcccctgccctctcttctgtgaaagaacatcctcgatccgcccgccgacattagcagccgtctaaaaagaaatctcacccccgatctccttggccatctgaagcttaatagggtgagtgagtctctcaataaacctcctcaccgtctctctctctctctctctctatctctcggtaggaagcagaagaatagcatgacgagctagatccacaaaatgggtctcatactcagtgactgacatactgcctactggagatgctcaaactacctgcggtaactctctctcaatgtgaccggaaggaacttctaaagaaatagctgagagaacttgtcccaagtaagaccagacgaccagctggtctggtcaacatataatctctccaccatctcttggcggaactaatcatttgaaacacaacaaaattgaccccattggtcttaactatatctatgttccgtagcaccgcatggtagcggtcaagataatcatgtgggtcctcagaaggtgcaccgctaaagtgatctgggaaaagcttggtaaacttgtccaatctcaacaagccctcagaagacatggcatgtcccttaccagcctgtgccacaacaattggctgaactaccccaactagcggggttgctagagtctaatactggggagatatctgctccagagtgttagtagcgggagtctagagctcctcccccagcctgagagatgactggtgccataagaaatgtatcggcctgggccacactctccataaggtcaacacagaccaaagcgttctgaagtactggggtggcgatgaacccctcgggcacctgagctggcccaacaggtacagtctaagttggaacctccttatcaaaatctacttgaggctccactactagtgctgctgctcaaactctaggctaagctttgcctctagctcagcctctgccatgactacgggctcggcctctgccatgactacgtgatcgacctctgcccctagtaggagctaccactgggggctttgactattgttcagctgaagatgcagtgcgtgttctcgccatctgcgagagaacaagagtagaagagttcaattagcagtggcagaacaaaatcgcacgacagagaagaatagaagtgaaattgttcctaactctatagcttctataagataagtacagacgactctgtaccgatcctccagactctactaagtttgctcgtaatttgtgagacctatgtaacctagtgctctgataccaacttgtcacgatccaaaattcccaccatcgagaccgtgatggcgcctaacatttcacttgctaggcaagccaacgttagaataatttatccatttttaatagtttaaattaaataatgataaagaactgaaatatatgcaataatccaaagtaaaaatgaggaagctaaaatagccaaacttctaatacaaccccagacccgatgtcacaaatgcacgagctactagaatagtacaaacaaaggtttgaaacaacataaagttgtctaaaaagaaagtacatagccaaataaaaagggaaggggactccagaagttgtggcgctgagcagctgtacctcaagtctccaaaagcttcccaatccgagcacgctaataactatcgctgggaacgactccaaaatctgcacaagaagtgcagagtgtagtatgagtacaaccgaccccatgtactctgtaagtgtcaagcctaacctcgacgaagtagtgacgaggctaaggtaggtcactcacactacaacatgtatgcagtatataataaagacagaaaaggaaatacgaaaagaaataagatagtcaactgaaaataatggctatagccttacgaaataagctagtgacgttcagaattaccaatccttagagtttcaaatgaaaatactgaaaaccaacacaactcaaggaaataaaaacacatagattgttgttgcgtgcaacccgacatacaacacagaatcctcccttattttaccataacaacatcaacaacaataaataatatatatatatatatatatatatatatatatatatatatatatatatatatatatatatatatatatatattgcggtacgcaactcgataccaccatataacaatatcagtatcataattcacatttatttcaccgtatcagtccacttttattccacctattgcagctgcaacccgatcttaccatatcagtacaacttcacccttattccatcatatcaatccacccttattttacctgttgcgacgtgcaatccgatcccactatatcagtaccaaatactcaatgtgcacagtcaaatcaataattcaaatcacaaggacctttacaatcaataaataccaagctgaaccaataagggaaccttgtacaatatgggaatttacacgggttatactacacaataagtcaagttcggtaaataacaattagaaggtgcaagtaagccgattagggcaagtagtagtggatcataaaaatatgaaagagtccttcattattaacaggaaaaacaatgattaacaggtagcaaataagcattaaaggcatttaggacatataatatttaaaacaaggaaggagataatcaaggaaaagcagaaaatcagggaaaataggtaattcggtggtgtataagcactcgtcacctcgcatatacgccgcaacacatgaaatacacatagcacacagttcgaggattcctaattccatcaagtcaaggttaaactcaaaacttatctcacatcgtagtcaattcagagctctattatgacctttcctctagaatccgccttcaaaccacttgtatctaaccacaactgactcaataatatcaaatattgctaaaagaatcaattacaatgcataaatttagaattctaccgttttcccaaaaagtcaaaaatcgaccccaggtccgcttggtccaaacccaaaattcggaccaaaacctaattactcattcacccctgagcccggttaggtaatttgtcttgaaatccgaccttaatttgaggtctaaattttaattttgcaaatatccttgattctacacaaaccactaattttcaccatgaaaattctagattttaggttgaaaacttattaaatataatggaaaattgaaagaaaataggttagaatcacttaccaatgaattggggaagaagagttcttggaaaaatcgtctctagggttttctagttttgaaataaagaatgaacaaaaatcccgtctaactcaacttttacacagttgcagatgtcgcaattgtgatatcttgttcgcaattatgaacatcgcaattgcgagaaagaggtcgcaattgcgaactcctctcagaatcccagtaatcgcatttgcgatggtcgcaaatacgaaccctgatgccctcacaaatgtggatctttcttcgcaaatgcgaagatcatcacaaaatgtgttgagtcgcaaatgcgactctaccttcacaaaaacggaaatggaaagtttgcaaatgcgaactttcacctcacaaatgcgagtacccctcctaccatgcccaggctcgtaagtgcgatggtttctttgcaaatgcgaaccaaatttcgcaaatgcaagatctgcagcagacaccaaaaactaaatgcatctgctatgtttctaagtccaactcacctcgtcgcctatccgaaacgcacctcagccctcggggctccaaaacaaacatgcacacaagtccaaaaatagaacttgctcacgcgatcaagtccatttttttggaaaattgaatcaaattgtacttttttttataattctgcaaattgataaaatttatgtcaatttttacgtcctttgttcctcacattcttccacttcaaagataagatccaaagacagaggttttctattatctccatgtcgtactcactagtttctcttttaatgtcttcccgcatttctttatttcgtattttcatctttaggtaaaaattcaaaggcttatattctttttctttctcattagttgtcacttctcaatattaaggatattgattttattgtggatgggagattcatcattacaatgaataaggcattagtatctaaacggtataatgaaacaaaaaatatacgtgttatagaaatgtaattttataaaagaaattatcgttataataatggataggtaatatactattataaagaggtataatataacataaaagtttgttttcaaagatgaaatacagtcattgtggggtttttagaatctcacataaatgcttgtggcaaacgtaacagcaaactttttttgaaacccccacaatttattttgtaaaaaatcatcacaaatcttaaaaataatcccacaaaatgagctttttcttgtagtgccttttgcaaatattatgcaaaccggtatagggattttaacatttgattagtgcgattaaaaaatatgtcacaaacttgaaagataactcgtaaagtcacagaatggttgaataattcattgtactacacaggatatatcgataataacacagcaataaactaataatttaatcacataattttctagcaaactgaatgtaaaaagggatcggagttcattctaaaacttattttaggcaagtttcgtatcggaatgtgaggggaaagttaggagcaatattttttttaaaccgccttgtagtagcgaggggtttgacatcgaaccctatcatgtatattaataatcaaaagatgaatatataatgaagggggacattaaacttaacctcctcagaatatggatgagagttcgacatgcccagctctttacagttagcttgcaaacattgatgcaatgaaagatattacacattggagaatgtacagtataatacattaaacttctctccataatatatgttaatgctgattctaggaaaatgctagaaacaaacttagcttatccattagcatcatatacaaaagtagtcttggagtttcttactcagaagcttgtcatccggtacttatccatgtactgttagaaaaataacgggataaaattaatctggcttcgataaagtaatcactatccttaaggaatttaagcttcccactttgttgctgcatggataatagcagaactcctccaggattttacaatgccactgaaatcgagtttcagcaaataacttgaatttcccataagaacagaatatttgtgagttatagaaaataagtaaaagagaaagagatgaaaattggtaaatctttctcttttcttgactaaagaatgcattttatgggtctagcactcccgtcataagacgtagaagcaaaaaaaaaaacatgtcgtagaaggagataacaggtggagccaacaacccactaagactaacctttctacaactacatccccgagtgcaaccaagtccatttttgaataagaaagctaaatcatcaccttatttgaggaagtagccatggaagattgggtttgtatggcttcctggggtcgaaagatcttccttcaaccttgggcaaggacaatcgatgattggcttaatttcctgagggactctagtatcaaaaaatttcggctttcatcgtgaaagtgtcacatttagattgttcttatttccctcaggaatgtttatcatggagcccagtgttgccaatgcatctgcgaacttattttttctctaggtagtggagagaaactgattttcttgaattgctcattgagcttttcagtactttcgtaactgatctttttgtaggtgatgggttggggaatttttggctgtggcaagtcaaggaaaggttaggtcaaggtatttcagacagaagtcccatcaatcagaatctgaagatgtattttgttttggagatgatatcgatatttataataatcttaggagtctgttggaattaatagactcatcttttcataaacaggcaccttttaaaaccaatggtcacctattttgaatttataaaaaaaactattgaaaaacatttttcctgaaattaatttaaaatattttaaattaattaataaaataataggtaataaaatattaattcaggctacttaattggctcaattgtaccaagtgcccaatcttgactattaataataaagtcaaatttctatttacctccaaaatattctttaaaatattcaaactatatgagacaaagaagtgcttttaacaacttcttcctttctttagtttctcaatgaggtaagaaacaacctcttctcaaatacgtccatcaaacactaactaatctaacaagtactactgggctctagctcgacttggaagctcttgagcagagaaattcgtttagttggtcctttcttatccttcttcagctagagcatcagcaactctattagcctccctttagcaatgtgtgatatggaaaatctcaaattgtgatatgaatttttatattttctctgtaacccaattaattaccaataaggaatctaagtcaacacaaatcttgttaatgccttcatccatgcaccattcaagaccatcacataaagctatagactctgctgcattattaccctggataccaaaaggtgctgtaaaaataggtattatctcacattgatgtccccgaacatctcccccaccaccgttggttcctgaattgcccttggagcatccattagtattgagtttaatcatatcggcctggggaagtttctagatagcaatggtgatgtttagttttagctttgttgtttcacaaatagtaatcatttggttccaagtggtgtctatattgacttgtataaactgtttgtgaataagaatagcagcttcacagcatatcaagtgagctatcttagaaatgtaaattctttcttgttcataatttttcagcacctagtcttccaaatatgccaattgattagaagaggaataacatgtagaataagcttatgaattggattctgataattagcaaaccaccatgttaacatctcatgtctaattttccctcaagattctttaattccaaactggttctgaagatattccatatattcttgctaagtttgttacttctaaaaatgtgattcacatcctcactcataggaatatcacaacagtcacacctagagggatatgaaaaagtaagattcctgatattatcatcagttggtagtttatatatcaatagcttctagttaaagaatgaaattttaaaaagggatagccttatgccacagattcttgttaataaaagtgacacctttctttgtctcagagcattccaggtagaggaatatgtgaattctccattagtagctccagtctatactgcttggtcaagtttgtttgagataacaattttgatccctttgatatggttgactagatgatctgggatgcactaggataacttagcaatatcccaattgttgttagggatgaaatgagaaaccatagttttatggagtacgttatagttacatagagttgatatagatcccaaacttgtccagttatcccaaaggaaggatgagttacccttttggatcctccaatatgtttggtctatatctttgtttatattcattaaactcctctaaggtctagattgcttagctttcccttttttggccactggatgtaatctgctactatatttagccttcagaaaagttaatcacaatttcgtgtcctgaatagcaaccatagtgtagctataaaggacttagaaatatcatataatcttttaaaaccaattcctccctcttcagtagggtaacatagtttggtaccagtgatgtttcatattaccttcctgctgcccccagaagtaattttcaaagtatctctcaagagttttgtgtacagtctttggggtttagtagatatataggagatttataggaatatacagtagataatacatgtttaatcagtatggcttttccactagtaaataattgtgatgacctaataagtcactttaagctttagcctttaatttcgtattccgagatctcaactagtaccatttagtatttctcaatttatgtgtatagtccgtgtcatgttcataaagtttttatgtgaaaaatttaagaaaatgtaaaaacttgccttaaaactcatttgaccgtggttttttgccttaagaaaatgtttggaatcgaattcgcaagtccctaacctgaattaacatggtttgttgaaaactagtgatttgaaggcttaaagaattcccaagtttgaccgtgggttgactttattactaccaagttcatatttcagttctgaaacatggaatgggttaatttcaccatttatgacttgtttacaaaatttagtgcaaaacggagttgatttgacgtaattcggacgttcggtagtaaatttgtatgttttttagtttttttgaaagttttattcattttaatgtttgattcgtagttctcagtgttattttgatgctttgatcgcacgatcaagttcgtacgatattattatacttatgtgcatgtttggtttggagcccgaaaggctcgggtgagtttcggataggctacggatcaattttggaattaggaggattactggtttcaaggattcttgattctggtgctttgttcttcgcgatcgtgaagccactcccacgattgaaaagagtaaccagggatggggtgggatttcctctatgcgaacgctagtttgaggtcgtgaatgcgaagcaatagtgggatcactcttcggcctggaaggggatcagttgtgtgttctacgcaaacgcaatcgaagggtcgagaacgcgaagtccagaggggaagagtcatctgaatgcgtaggacatctcacgaacacgaaggccactgggaccgctgcactttgtgatcgcgttggcccttcgcgaacgcgaagaaggcttgacgcccattgacttaaatgtcctaaagacgggattttcttcatttttcaccatcttcacattagagctcgacctagaggcgattttcaagaaacatttcttctccactccgtaggttagtatacttaaactcgttttcttccatttccatcaatacccattgatttctaaccttaatctacgctctttcatggtagaaaattagggatttgggtagaattggagacttttgtaaacttgagtttagacctcaaattgaggttggattttgaaactaatcacataatcgggcttggggtgaatggataattgagttttggtcttaattttaggttttgaccaagcgggcccagggctaacttttgttgactttttagaaaaagtgtaaagttctttgctttctctattgtaattgatttttctagaattgatttttctagaattgattaatgatattaagtcgattttggttagattcgattggtttggagacgaattttagaggaacgttcccggttgagctttgagttgattgcggagtgaggtaaatgttggatctaaccttgatttgagggaattaggaacccttaaactatatttatatgaattacatggtaacagcgtatatgcatggtgacgagtgaatatacgccgtcaaaataattatttccatgtccttctcgtacttcatgaattatcttactctatgccttaattgttacatgctttaattgtcttctatgccgtaatttattacttgtcattaattatatttgtattaaattgttcgttccttctatgactccatgattaattgttacttgccttaattgccttatttgtataccttaactttcatatatttggcttgtcttgttgcttttgtattaattgtagtatttcttgatttggtacagggttcctttattgctttgctttcatattcttttatcgtagaaattcttgtgaattgaattgttaggttgatttcatttattgaatttttgtatggatcgagtttcacgccgcaacggttgtgtacgtaatacttgatattgataaattgtgacatggtgaaataagggaggattatgatattgattatgattatatggagggatcgggttgcgcgtcgcaacggatttaatatgtgattcttgatattgatatggtggaataagggaggattgtacgtgtatagtgggatcgaggttgtgtgccgcaacggattgtgtgtgccgcaatggattgtgaatgatgtattcattgttgttgttgtgttgattttcagtgttattacatgaaattatgaggtcggttattccgggttctctgattacaagaatgtcacgaccccaaataccccggtcgtgatggcgcctatcacgatactagccaacccaaacaagtaactacagtaaattcttttataaaatcattttctaacactaattaagtctcaatttttcataagaaatatctaaatcacttaaatatgcgggaaaaaatagtaaaacatcaaatcaacacagcccaactacttggtatcacaagtttagagcctctaaatacaacaagtctaactagctaatacataataagccctaaaatgtagaaaacaaagataggaaggtggaaagcagggctgcggacgccgtgcagctactttgcagcctccggtaagctccgataatgctggggaccctcactctactgctcgggcacctgaatatgcacacaaagtgcagggagtaacgtgcgtacgccaactcagtaagtaactaaagtaaataaggtctgagtgtagcgacgagcagttaaaaatcatatataaaagtatacaacagagtatcaaatcaaactcaaaagtttaaaagccaattacttcgtaaaaactttagtttcaattgagatactttgaaatcatttacttagtagttttcaacagaggcacctcataaaggaagagtgaaatcagcaaaaattcataaatgggcccctcgggtaaggaatcactcataaatgtagcctatcgggcaagcctctcagtcacttgtgagtcagctcttgtcacacagtactcacactcagtactcaggctcaataatatctcataatagtaataatcataataattgttgcagcgtgtagcccgatccatagtttatagtcgactacgctcactgggggtgtacagactccggaggggctcctacagcccaagcgtcatatctctgcggcgcgcagccaaatccaatatatatatatatatatatatatcgttgcggcgtgcagcccgatccatataagtatcactgcggcgtgcagcccgatccataatatatacatttattattgttgtagcgtgcatcccaatccgtaatatatatatatatatataatcctcaccattaggtcctcaacctcactcagtcattaacctcacagcccctcgggcataacagtggaaatcagggaaactcagcccaaacagttttcacattttaagaagtagagtgataaaaactaggtttaaacaataaacaggtcaaatatgattgggatatgctttcaaacaaatagagtgaggaaaacagtaaaatgcccctaagggtctcaacaggtcggcacaaggccccaaacatggcatacagcccataatatagtatcaatctctaaaatacgtgatatcataagatttcaaatgaaatacgtggcttactagtcgctataggacgaaccaagtcacaatctttactggtgcacgcccacacgctcgttacctagcatgtacgtcacctcatttatcaaaacaatacgaaataccggggttttataccctcagttccagatttacaatggttacttacctcaaaccggatgaaatactactctgcgacgctattgcctctcgcctcggcctcaactcgcactgaatctacccaaaatcagaatcataacattagaatatgctaagggaatgaagccatcgcgaaaataatcaaattataccaaaaatcctgaaattgatccaaacctgacccccgagcccacgtctcgaaattccataaaaatcacatcaatagaatccttatccccaccccccacgagtctattcataccacaagcatcgaaataggacctcaaatggcccctcaaatccccactcaaagttctccaatatcaagccttaatccctcaattttctcccttaatgtccactaataccataattaaacaatgaaaaaatgatcataaacacaactaatgaagcttaggtagcttacccaactgataatcttcgattccccttgaaattcactgccctagctcacttcccgtcttcaaaaatggagaacttaggaaaaatgcgcaaccttatatactttctgacccaggtatttcccacctgaagtccctttctccgcttctgctctactgcttctatggtcctacccaccgcacctgcggaaataactaaaaacctcatgaccgtacctgcgccatcgcagatgcgtccataagttcgcttctgcggctccgcctgacttgcctcttggccgcttctgcggcttgcttccgaatctgcgggagtcgcgcctgcagcctcccaaccacagatgcggttatgacagcaatcataaaacttcagctgccaaactcaactccaaaacctcccgtcaaccatccgaaatcaccccgaggcccccggggcctcaaccaagagcacgaactagtcatataccaatatccaaacttatataaatcttcaaaacacctcaaacaacatcggatcgaccaaatcacatcggattcaagcctaaagttctaaaatctttgaattacgcttttgttcaaaaagtctaacaaaccacatccgaatgacctgaaattttgcacacacatcccaaatgatataacggacctactgtaactcccaaaattccattctgactcctatatcaaagtctcacctatcaaccggaaaacaccaaaattccattttcgccaattcaagcctaaatctactccagaccttcaaatccattccaatcacgctcctaagtcccaaatcatctcccgaagctatccaaaccatcggaattcacgtcaagccttgttcacatatgtcaacatccggttgacttttccaacttaagcttactcaaaagatactaagtgtctcaaaactcaccaaacctctccgaactcaaaccaatccacccgataacatataataccactaaacaaaacaataagaagtaaaaatgggggtaaacggagcggtaactcatgaaatgaccggccgggttattacatcccccctcttaaacaaacattcgtcctcgaacaagttaagaaacatacctgaagcctcaaataggtgaggatatctgctccgcatttcccgctcgatctcccagctttcctcctctatgggtcgacctctccactgcactttcactgaagctatatccttcgatatcaactttcgaacctgatgctccaaaatagacattggttgcacatcataagtcaaatcatcatctaactgaaccgtgctaaaatccaaaacatgagacggatcgccaatatacttccgaagcatagaaacatgaaataccggatgcatactcgacaagctaggtggaaaagcaagcttataagccacttccccaatcctctgaagtacctcaaaaggccctatgaatcgaggagtcaatttacctttcttcccaaatctcataacacccttcatgggtaaaaccttcaatagaaccttctcaccaaccatgtaggacacatctcgaaccttcctgtcagcataactcttttgtctcgactgcgctatacgaagcctctcctgaatcaccttcaccttgtctaaagcatcctgcaccaagtctgtaaccaatagcctagcctcaccgggctcaaaccaaccgaccggagatctacaccgtctctcatacaaagcctcatatggagccatcggaatactcaactgatagctgttgttataagcaaactctgcgagcggtagaaactgatcccatgaccctccaaaatcaatgacacaagcacacaacatgtcctccaatatctgaatagtgcgctcggactacctgtccgtctaaggatgaaaagttgttcttaactcaacctgagtacgcaactctcgcggcacagacctccaaactgtaaagtaaactgagttcccctatctataatgatagaaactgggatactatgcaaacgaacaatctccggatatagatctctgccaactgctctgaagaataggtagtacacacaagaatgaagtgcgcggacttggtcagcatatccacaatcacccaaatagcatcgaaattcttcaaagtccgtgggagcccaactacaaagtccatggtaatctgctcccacttctactctggaatacccatctgctgaagcaagctacccggtctcttatgctcatatttcacctactggcaattgagacaccgagccacaaatcccacaatatctttattcattctcctccaccaataatgttgtctcaaatcctgatacatcttcgcggcacctgaatgaatggaatatcgcgagctatgggcctcttctaaaatctactcccaaagcccatccacattgcgcacacatatccagccctgcatcctcaatactccgtcatcaccaatagtcatatatctggcatcgtcgtgctgaactctatccttaaggacaagcaaataaggatcatcatgctggcgctctctgatgcgatcaaataagaaagaccgagaaatcatataagccaatacccaactagattccgaaatatccaacctcacgaaccgattggccaaagcctgaacatcaactgcaagaggtatctccccaactggaatatacgctaaactccccatacttaccgccttcctactcaaggcatcggccaccacattggccttttccggatggtacaagatagtgatatcatagtcctttagcagctccaaccatctccgctcctcaaattgagatccttctatttgaataagcgctagaggctatgatgatcagtaaacacctcacaagacacaccatacaaataatgcctccagttcttcaatgcgtgaacaatggaagccaactccaaatcatgaacagggtagttcttctcatggggcttcaactgataagaagtataaggaataactctaccctcctacatcaatacacacccaataccaaccctcaaagcatcacaatacacgatatatacattgatggcaaaactaacactagagttgtggtcaaggcagtcttgagcttctgaaagctctcctcaaactcatccgaccacctaaatggagtacccttttgagtcaacttggtcaagggagatgtgatagaagaaaatccctaaacaaaccagcggtaatagcccgccaaaccaagaaatctacgaatctttgtggctgaggacggtttgggccaactctgaaccgcctctatcttttttggatcaacctgaataccctcgctggacaccacgtgccccaagaaagccactgaactgagccaaaactcacacttagagaactttgcataaagcttctcctcccccaatctctgcaacacaactctcaaatgctccgcatgctcctcctgactacgtgaatacaccagaatatcatcaatgaaaactatgacaaacgagtcgagataaggtcaaaacacgttgttcatcaaatgcatgaatgatgctggggaattggtcagcccaaaagatatcacccagaactcataatgaccatatcgggtcctaaagttgtcttaagaatatttgagtccctaatcttcaactagtgataacctgaatggagatcaatcttagagaacactctccctccttgaagctggtcaaacaaatcatcaatgcgaggtaggggatacttgttcttagttgtaaccttgttcaactgcctataatcaatgcacatcctcatcgtaccatccttcttcttcacaaatagaataggcacaccccaaggcgacacactaggccgaaaaactcttatcaaggagttcctaaaactgctccttcaactcccctagttccatacgatatggtggaatagagatgggctgagtgcccgacaccaaatcaataccaaaatcaatatccctgactggtggcatgcccggcaggtctgcgggaaacacatcgggaaaatcccttacaataagaatagaatcaatactagaagtctctgcactgacatctctcacaaagtctaagtatgaaagacaacctttcccaaccattcgctgggccttcagaaacgaaatcaccctacaggggacaaaatcagtagaacatcgccactccatctgtgtcacacccggcatatccaacattactgtcttagtgtgacagtccaatatagcacgacacggagatagccaatccatgcccaatatcacatcaaagtccaccatacagagtaacaatagtccactcgggtctctaggcccccaatagtcaccacaaacgaccggtacacacggtccacaataatagtatcgcccaccggagtagatacatgaacagatgaaacaagagactcacgaggcatatctaaataacgagcaaaatatgatgacacatatgaaaaagtgtaactgggatcaaataacacagaggaatctctgcggcagactgagacaatacctgtaatcaccacatttgaagcaacagcatctggtctagctgggagtgcatagaaacaagcctgaccaccacctgatcgacctcccactctggggcgacccctatctgactgaccctcacccctagctacctgagcgagtggtgaagtaactggagctgaaatcgagggctgacccctctactgagatagaccctcaagaagacaaggacattgcctcctcatatgcccaatctctccacactcataaaaactccccggtgctggagacagggactgaagggaacccctggcaccggaatgaccagtagaaggacctagcatggaagaaccctgaactgatggagcacgggacgaactctgggctagaagggcactgagtgatgaatggccctgatgaggaatgtgaaaaccatgacccgatgatgccccacggtaacttggatgagctaactaagcctgcctgaagggatggtctctaccttgctgaaattgaactctcgaaagagcactaccaaagctgccagatccccgaggcctcttggcctctctctcctctctctccatgcaatgaactgactcaatctcacgggcgatgtcaacaacctcctcaaaagtagcacctgacaccctctcctaagtcatgagaatctgaagctgatatgtgaggccatcagccaacctcctgatcctctctcgatctatgggaaccaaccagaccgcatgatgagctaactcagagaactgcatctcataccgtgtcacagtcatatctccctaatacaactgctcgaactgcctatgtagctcctctctacgagactgtggcacatacttctccaaaaaaagaacggagaactacttccaggtaaggggcgctgcaccaacaagcctacgcctcttataagcctcccaccaagtaaatgcagctccagaaaattgaaagatagtaaatgctacaccactggtctccaaaatacctgttgtacgaagaatcctctaacatttgtccaagaaaccctgggcatccttgccctcagtaccactgaaagtcggaggctgaagtataccaaacctctccaatcgacgctgctcgtcgtctggcataactatttccacatactcttgatctggtgcaaccagctgggctggaggtgcctccagtgtctgaagtccctgcacaacctgctcaggtgtgcgagcaacgggagtttgagtacctcccccgacctgagaagtagctacggccgtagtaactgagaccgcctgagccaaactagtgcacactgatagaatttgagctagagcctcctgaaggcctggaatcataataggcacaaccgatgcctgagctggtgatgctggagcgtccgtaactaggacctgatcgtgaactggggtggctagtggatctgtaggtggtgccctagttgatgtgcgggctacacccctgcccctaccacggcctcgaccacgtcttcgacctctagtggccccaactggtggtattggtggtcatccatcctgaccggtagcacgtgtcctcaccatctgtgagagaatagaataacagaagtttagtactcggatcaacagattcgcacaacaagatttcaagaatataaagtttttcctaaaggttctgtagcctcctgagtttaaatgcagacgtatacataccgatccttaagactctactaaaccggctcatgactcgcgagacctatgtaacctaggctctgataccaacttgtcgcgaccccaaataccccggttgtgatggcgcctatcacaatactaggtaagccaacccaaataagtaaccacagtaaattcttttataaaacaattttctaacactaattaagacttaatttttcataagaaatatctaaatcacttaaatgtgcgaaaaaaaatagtaaaaacatcaaatcaacacagcccaactatctggtgtcacaagtctagagcctctaaatacaacaagccagactggttaatacataataagccctaaaatttataaaacaaagataggaaggaagaaagcaaggttgcggacgtcgtgcagctaccttgcagtcttcggtaagctccgataatgctggggaccctcactctgccgctcgggcacctagatctgcgcacaaggtgcaggaagtaatgtaagtatgccaactcagtaagtaactaaagtaaataaggtttgagtgcagtgacgagtagttaaaatcatatataagagtatacaatagagtatcaaatcaaactcaacagtttaaaagccaattacttcgtaaaaaattcagtttcaattgagatactttgaaatcatttacttagtagttttcaacataggctcctcataaaagaagagtgaaatcagcaaaaatgtcacaaatgggctcctcgggcaaggtatcactcataaatatagcctctcgggcaagcctctcagtcactcgtgacttagctctcgtcacacagtactcacactcaacactcaggctcaataatatctcagagtagtaataatcataataaccgttgtggcgtgcagcccgatccatagtttatagtcgactacgctcactgggtgtgtacagactccggaggggctcctacagcccaaacgtcatatcgctgcagcgcgcagcctgatccaatgtatatatcgctgcggcatgcagcacgatccataatatatacatatactattgtttcggcgtgcaacccgatccgtaatatatatatatatatatatatatatatatatatatatatatatatatatatatataatcctcaccattaggtcctcaacctctcttagtcattaacttcacagcccctcgggcataacagtggaaattaggaaaactcggtccaaacagttttcacattttaagaagtagagtgataaaaccaggtttaaacaataaataggtaaaacatgactggggatatgctttcaaacaaataggtgagaaaaacagtaaaaatgcccctaagggtctcaacaggtcggcacaaggccccaaacatggcatacagcccataatatagtgtatcaatctatatgtaatatcataagatttcaaatcaaatacgcgaattactagtcgctacgggatggaccaagtcacaatccctaccggtgcacgcccacacactcgtcacctagcaggtgcatcaccttatttatcaaaacaatacgaaataccagggttttatacccacagttccagatttacaatggttacttaccttaaactggatgaaatactactctatgatgcctttgcctcttgcctcgacctcaactcgtgtcgaatatacccaaaatcagaatcataacattataatatgccaagggaacgaagcccatgcaaaaataatcaaattataccaaaaatctagaaattgatccaaacccgacccccgggcccacatatcgtaattccataagaattacatcaatagaatccttatcctcccacgagtttattcataccacaagcattgaaatcggacctcaaatggcccctcaaatccccactcaaagctctccaataccaagctttaatccctcaatttgctcccttaatttccactaataccatgattaaacaatggaaaaattaccataaactcaagtaacgaagcttaggtagcttacccaattgataatcttcgatttccccttgaaattcactaccctagctcacttctcgtcttcaaaaatggagaacttagcaaaaattcgcgaaggaaaccttacatactttctgacccaggtatttcgcacttgcggtccctttctctgcttctgcactaccacttctgcggtgctacccaccgaacctgcggaaatgactaaaaacctcaggaccgcacctgcggtcattctctagcacctgcgccatcacagatgcgtccacaagtccgcttctacgattctgcctgacttgactcttggtctcttctgcgacttgcttctacatctacaggagtcgcacctgcggcctcccaactgctgatgtggttatgacagcaatcataaaacttcagctgccaaactcaactccaaaacctcccatcaaccatccgaaatcaccccaatgccctcggggcctcaaccaaaagcacgaactagtcatataccaatatccaaacttataacaatcttcaaagcacctcaaacaacatcaaatcaaccaaatcacatcggattcaagcctaaggttccaaaatattttgaattatgcttttgatccaaaagtctaacaaaccacgtctgaatgacttaaaattttgcacacacatcccaaatgacacaacggacctagtacaactcccggaattccattccaacccctatatcaaaatctcacctatcaatcgaaaaacgccaaaattccattttcgctaattcaagcctaaatctacttcggacctccaacccaaatcatctcccaaagctatacgaaccatcggaattcacattcgagccttgttcatataagtcaacatccaattgacttttccaacttaagctcactcaaaagagactaagtgtctcaaacctcaccaaaacctctctgaactcgaaccaatccacccgataacatataatacagatgaacaaaacaataagaagcagaatgggagaaacggagcggtaactcatgaaacgaccggccgggtcgttacaaagaattgggttcttttcatgagttaactgccttactttttttgttttccttttctattactattactgtaatgcgtacaagttattgtgagtgacccgccttagccttgtcactatttcatcgaggttaggctcagtatttataaagtacatggggtcggttgtactcataatacactctgtacgttttgtgtagattttggagtcagtcctaacggcggtcagtagattgatcggatccaatgcttgtcggagacttgaggtatagctacacagtgtttgcagccctgaagtcctcttctacattaccttagaagtttattttaattcaaacagttatgctttcattcagactattatttatagtactctagtcgctcgtgtacttgtgataccaattctgggattgtatctagatatcgttgttattttagtttattcactctattttagtttattccacttattggttttcatttagtttaaattgttaaaaaagactaataactatttctaatgttggcttgcctagcaagtaaaatgttaggcgccatcacgatcccaagagcgggaattctgggtcgtaacaagttggtatcagagcattaggtttcctgcgtctcacgagccacgagcaatcttagtagactctggaggatcggtacagatatgtttgtacttatcttttataggttgtggagtttagaaaaaacttcacttttttccttctctatcatacgattttattctatcattgatgattgaactattctattcttgttctctcatagatggcgagaacacgtacaacacctacagccggataggagccgaagccccctatgacaactactactaggggtagaggccgaggtagagccagagctcagtctagagctcgagcaacagcacccaaagtggagcctcaaattggtcacgaggaggaggtccctactcaaactgtgcccgtcggaccagcttaagccctggagggattcatagccactttagtgctttaggatgctctagtccacttggtggatcttatggagagtgtggcccagaccggtgcattcctggtggcaccacccgtcttcgggatgggggggagcacaaattcctgctactcacacctcagagtaggcggtgcccctatatcagactccaacatccccgtcgttgggatggttcggtcgattgttgtggcacgggttggtgataggcccgctatgtcttctgaggctttgttgatgatggataagtttaccaagatcttccttattcattttagtgtatcttctgaggatccccaggattacttggaccattgccacaaggtgttgcacaacatgggtatagttgaaaccaataaggtcgactttgcactattttagatgactggttccgtcaagagatggtggagatattatatgctgactagaccagatagtttgcctgcacttacctgggattagttttcatagctatttctagagaagttcatcctggttactctgatggaggattaccccaggcggtttaagcgtcttcattagggtagtttgactgttacccagtacgagactagatttgtggacctagatcacgatgccattattttactccctactgagagggagagcaggaggagattcattgatgggctcacttttactatcaggatacggataggcaaggagactggagatgatatttctttctagaggaccgtagatattgctagaccgatcgagatagtccatggtcaggagagggagccggtgtctaataagaggcctcgtcattctggtagtttcaatggtgcctcatctggaggcaagggtatttttgatagaggccatccttccaggctatttcaatcagcgctttaggcatctcacaatgcttcggcgagtcggggtctttatgtatctcattctggacagccagcctatagtgcaccattaactcctattagtgtgcctccgatccatagctatcaccgtggttatcctgcctgttcgggtcaacttcagtttcagcatccacagcaataagatgggtgttttgagtgtggaggtactggtcatatgaggaggttctatccaaattgttgagcagcatgccatagcaaagttcttgtgctatggtcctagcaccggttgttccatcacccacgcaggtagctagaggtaggggtcaagcagtaagaggtggatctcaggccattagaggtggagtttagggcattagaggtagaggctagccagatagaggccgtccgagagacggaggtcagagtggtgggggccagccccgattttatgcattcctagctagacctgaggccgagtcatttggcgccgttatcacaagtattgttccagtttgccatagagatgcattagttctatttgatctgggctttacttattcctacgtgccatcctattttgcttcatatatggttgtgcctcgtgattatttgagtgctcttgtatatgtgtctatcctgtgggagattctattattgtagatcgtgtatatcgcttgtgtgtgattactattggtagtctttagactactatagatatactacttcttgatatggtagactttgatgttattttgggcatggattggttgtcaccattgtcatgccaagacagtgaccttagccatgctgtggttgcctcaattagagtaaagagggactcttagccattctaccagtagggttatttcttatgtcgaggttcgacgtatggtcgagaaggggtgtctagattatttggcctatgtttgtgattcgagtgcagatgttccttccatggattcagtatttgttgtgcttgagtttccaaaggtgtttcctgcagatctgccggggatgctacccgatagaatattgacttctatattgatttggcttcgagcactcagcccatttccatcccaccatactatatggccccactggagtggaaagaattaaaggagtagtcgcaagatttgcttgataagggattcattagacctagtgtctctccctagggtgcacccgtgttattcatgaagaagaaagatgggtcgataaggatgtgtatagactattggtagttgaacaaagtcagtatcaaggacaagtatccgttgttgatgatttatgaattatgagatcagctttagggtaccaaggtgttttcgaagattgatttgaggtttggctaccatcaattaaagattagaacattggatatccttacgatggcttttcggactcggtatgggcattatgagttcctagtaatgtcattttgggctgacagattccctagcagcagttatggatttgatgaaccgggtgttcaagacctatttggattcttttgtgatcgtattcattgaagatatcttgatctactcccgcagtcgagaggagcatgagcagcatcatcggattgtacttcagactctgagatatagttagttatatgccaagttttgaaagtgtgagttttgcttagactcaatcacctttttaggggcatgttgtgtcgaagagggtataaaagtggatcctaagaagattgaggtagttcagaactggcctagacctacttcagatacaaagattcagactttcctaagtttggtgggttattatcagcggttcatggagggttttcatccatagtatccccattaactagattaacccagaagggtgctccattcaggtggtcgtatgagtgtgagttaagctttcagaagctcaagacagctttaactatggcgccagtgttggtattgcccacatattcaggatcctatatggtgtattatgatgcatctcgtattgggctcggtgcagtattgatgcaggagggcaaggtgattgcctatgtgtcacggcagttgaaggtacatgagaagaattaccatgttcatgacttagagttaggagccattattcatgcgctgaatatttgggggcactatctctacggcgagtcatgtgaggtattcatagatcattggagtctacagtattttttcaagcaaaaggatctcaacttgaggcagatgaggtggttggagttattgaaatactatgatatcaccattttgtatcattcggggaaggccaatgtggtgtctgatgccttgagtagaaaaacggtgagtatgggtagccttgcgtatattccagttggtgaacggcccctagcatcagatgtttaggatttagccaatcagttcgtttggttagatgttttagagcccattcgtgttaaagcttacagggtccctcggtcttctttgtataagcgcttcagagagcatcagtatgacgatccccatttacttgtatttaaggacacggtgcggcacggtggttccaagcaggttactgttggagatgatggggttttacggatgtagggtcggatttgtatgcccaatgtggatgggcttcatgagtagattcttgaggaggcctatagttcccggtattccatccatccgggtgcggccagaatgtatcagaactttcggcaacattattagtagaggagaatgaataaggatatagttgcatatgtagctcagtgtctgaattgtcggcaagtaaagtacgaacattagaggcctggtggtttgcttcagagggtggagattcttgagtgcaaatcggagcgtattaccatggattttgttatggggctcccacggactcggaagaagttcaacgtggtatgggtcattgtggataggttgaccaagtcgtcacatttcattacagtggcagttacctatttttcatagtggttaaccgagatctacatccgtgagatcatccgtcttcacggtgtggccgtgtccatcattttttatcaagatacacaattcaccttacacatatgtaggtccatacaatgtgagttaggcacacgggttgagttgattataacatttcacccctattcagatattaaaggatatgtttcgccttgtgttatggattttgggggttcatgggatcaattcttgtcgcttgtggatttttcctacaacaacagctaccagtcgagtattcagatggctccctttgaggcattgtacgggaggtggtgtcgttcgccagttacttggttcgatccgggagaggctcgattgttgggcaccaatttggttcagaataccttggaaaaggtcaagatgattcagaatcgacttcgcacagctcagtctaggcaagcattatgccgaccgtagagttcgtgatgttgcattcatggttggagagagagtattgctctggatttcacctatgaagggtgtaatgaggttcgaaaagaaaggcaagttgagccctaggtatatcgaaccttttgagattattgagagagtgggtgaggtggactataggcttgcattgccatgtaatttatcagtagtctatccggtgttctatgtgtccatgctccgaaagtatcacgatgatatgtcacatgtgttagattttagcttggtccaattgggcaaggatttgacttataaggaggaaccggtggccattttacccctgcagatccaaaagttgaggtctaagagttatctttcagttcgagtaaagtggagagatcagtcgatcgaggcatctacgtgggagtctgagtcggacatgcggagtaaatatccacaccagtccagatacctttctatgtccgttcgggacgaacgtttgttttagaggtggagaatatgatgacccaaaaggtcattttgatttttagcctttaattccgtgttttaagacctcgactagcacatttagtgttcctcgatttgcatgtgcagtccatttcttgttctgaaaagtttttatgtgaaaaatttaagaaaatgtgaaaacttgcattaaaactcattgagttgactacggtcaaaattttgtgtaaacggacccagattagtgttttgacggtcccagtgggtccgtatcgtaatttaggactttggcatatgcctggaatcaaattcggaagtccctaacttgaattaacgtgatttgttgaaaactagtgatttgaaggcttaaagaatttccaagtttgaccgtaggttgattttgttactactgggttccgattttggttctggaacttggaatatgttcatttcaccatttatgacttgtctgcaaaatttggtgcaaaacggaattgatttgacgtccggttgtaaattgtatgttcttgagtttctttaaaaatttctttcattttgatgttggattcgtagctctcagtgttattttggtgtgttgatcatgcgagcaaattcgtatgatgttattacacttgtgtgcatgtttggtttggagtctgaggggctcggatgagtttctgataggctacggatcgattttggacttaggagcagtgttggtttcaagattctggtgtctggtgctttgttcttcacgatcgtgaagtcactcccgcgatcgcaaggagtaacctaggctagggtgggatttcctctatgcgaacgctaggttgatgtcgcgaacgcgaagcggtggtgggatcacccttcgcgaacacaaccaaagctatgtgaacgcgatgggtatggacctggaagggggatcagctatgtgttctacgcgaacgcgatcaaagggccgcgaacgcaaaggctagggggcagacgctcagtgacttaaatgtcccaaagacggaaactttctttattttccaccattttcacattagagctcgacctagaggcgattttgaagagaaaagttatccccactttgtagattagtatactttaactcgttttctttcattttcatcaacacccatggatttctaaccttaagctatgctctttcatggtagaaaattagggatttcggtagaattgggggttttgtaaaattgagatttagacctcaaattgaggtcggatttcgaaactaatcacataatcggactcttgggtgaatgggtaattatgttttggcccgaatctcggattttgaccaagcaggtccggggttgacttttgactttttgagaaaagtgtaaagatctttgctttatctattataattgatttccctaaaattgattgatgatattaagtcaattttggttagattcgattggtttggaggcgaattttagagaaaaggtcccagttgagctttgatttgattgcggagtgaggtaaatattggatctaaccttaatttgagggaattcggaaccttgaactatatgttatgtgaataacatgtgtaatagcttatatgcgtggtgacggtgtatataagccgtcaaaataattgtttccatgtccttctcgctcttcgtgaattatctctctatgtcttaattggtacatactttaattaccttctatgtcataatttattacttgtcattaattatctttgtgaagaagattgaggagaaagtggaaaactagtttttgtaagagattactgtttgaccaaaaattagttttgagaataaacaattaaatttctatttttcagggctactagcaatttatttgatcgagacagttacaaataacaaacaatgataaataagaaatagcgaaatagattaaatagaatggtgaagaggagaaaatgcttctaaattttcaatcccccagcgatctccgatagcaggtgtggtcgaattgcgaagctatttaaaagaatctaattcaagatgatgctttgtattcaagagagtttttcttctatttctaatgctcctaccttggagcattggggcagcctttatagtggtggggaaaactgtcgttccgagtttcgggccagtacaccaagatattagctaagaatcgagccagtacgccaagatattagctagtgggagcaagatcctcgatagtaaacgttgatatccacggcctacggataaggttgatcgagtctccgaatatacgcatccacctttcggatgcttgacattccgatgaccactatgagtatctcatcatagaagacggatcatgttacatctcaagcaaaagctagtacgacttaaactaatttacatatgtatttctcattacaagtaaaacttactcctcagcaagaaaaagaaatttactctcaaataaaatacacaagcaaacatagaacctagttacacaaatagttttcttggtgttccgttttcagatgacgactccggcgagtgcgagcgacgcctagggttcactctagccggctccggcatgcctgagccgactaagtgaggaaaattgagccgtgctttcgagccacgaattttgaaagcggcttgatcataagccaatgctgcatcctccggtgtctcatatgttcctaaccataatcttgcatttttcttattcggatcccttatctccgccgcgaacttgccccaaggccgccgccttacgcctctgtaccgcttccaatcttgtggcgcgtttgccaccttcgccgccacagtctccttattattagtctcttcaaattcatgagacttttcagtggcgcctactaaagtagggtttatcaatggtgttaattcaccatagtaaaagttgttttctgtagaaggagagttgctaaaacttgaactagggctattggaatccatagctgaaaagatttctggaatattagaatcatttagaagatgatgctgtatggattcaaggagggaaagatcagctgaattcattttttctcttcttcttttttttttttttccttttggtggagtttagggttttagaacgtacaatatttatatatatgcctgacagatgggaactaagaaaggaattctttctaaataaagttttttggaaatgcccgcgaaggttccatttgaagcacctgcatggcatggttatttttgtttgaatatatattttcctacaacaatattaaatttatatgtttatttgacaattaatttgtttttgtttttttggtcaggagtggtcgatgtagatcatgtcttgtagtaatttatttatttatttatttgggcaaaaccccacgtttcacgtttatttcttttgggtattataatcttagctcttttagatcgatctcaaagctggaagcttcttctctatatctcaaaagttgtacggaagttagcaaatgaaatgcaagttttgtaaagtaacgttctcgagaatatgattattgtagcatttgtctttaaaaaaagtcgatttgatatcttatttcaaggattttagattgaaaagagataactagaaacgtacaggggatatcttattgtagcattttgaatttattaacatttctgaataatgacatagaatcttagaaaaacaaaacccgcgttaatttctacattttagttcttttttgcttttttctcaaaggttgtgtgaattttgcaaatgcaagttctgaaaactgaagagctatcttttaaatttaaaaaaaaaatctcatcttacttccggtgtttttgattgaaaaagaaaattgtagattataatgactttgaaattttaatattttttaacaaaaagcatagattcttagaaaaaattactatctcatctcttgctgtgtaacctgacaggagacagtaaattcagtttcacaaacatgttcagtcgtagtaatagagggaggatattgtggttcataacaataattcccaaataaataatcttttcgatccacagatttaacaagacaatagagaatatcgaattgaacaattaaccggaaaattggtaccaacagtttgcttatattgaattatcaagattgttttccccaataactaatttttcacgaaagaagaaattaaatgattttccttatatggaactcaggttttccttataagtatgtcaaatcttacttcatagtattaattttaagcattagacattgtcgtcaatctttagtactcaaaactatcaccaaacactacttaaccatatacatatctgtattgggaaaaaactgaatttacattgtaggtgacgtggcatgacacgtagactggtcaaacggtcaaaacacaataaatagccaagaggcacgggtgacaacagataagggaaaaagaaagtaacattggtgcggaccgttactaaaataggtacgagtctcgtacctatccaagtcatctaaagaccgaagagcggaagaagttgaagatacgaatctgatgatgtaaaagagtttaaatatagcattaaatatcaaatacgttagaatatttgttttaaaaataaatgattgtgtaacgtttcttttaatgtcatttattgctcataattgcctcattaagacaaaggcattacctcttctcctaggattagctataaaaggagaagaactcaccatctgtaaggagacgaaatattattgggatcttactgtaatacaaaactatttactgctttaccatcattctcaaaagtattttgttttcgtctcctgattatcagtaacccgaatttctttttagccttgaccaaagactcagatttttggttaaacaaattggttccgttaccgagaatctgataatcttttcctttaagctatatcttgtccattgtcgtcaccatgtcaaacaacaacaccgacaataatagtaataacacattgggaaaccatgaaaatcaaatccatcaaaatcaaggtgacatggttccctcccctccagattcaccacgtcaatctcgtgaaggcactcctgttactgaatcctgtgttgatcaacaagaacaatctgaacactttgaaggagttacaactgaagctttacaaaagctaattgatgcacaggtcggcaaagccttcaggcacttgttagtcgattgcttgctgcaccacccacaccaactcctaataataatatattggagaatccccgttctggccttgataattctggaaacggagcaacccccagtgaaccacaggaagggggaccaggtaattcaaataattcatatttgcaaaatttagtactaaccttgcagaaacagattaaggaacaaaatgagcgtattgagcgaatccctggagttccgcctgtaataaaaggagtagacatggacaaatactcacaacaaccatggaagccaagtgtttctccccttccaattccgaaaaagttcaaaatgcctgacatcccgaaatatgatggtactacagacccacgtgaccacgtgactgcatttacaacaggcgtgaaaggcaacgacttgaccaaacaagaaattgaatcagtactggtcatgaaatttggagaaacattcaccaagggtgtattaacttggtattctcttttatctgaaaattctattaattcttttgctgagcttgcagattcttttattaaagcacattcgggagcacaaaaggttgataaaagcatggaagatattttcaaaatcaaacaaggggattcggagttgcttagaaattttgttgatagattccagcgtgaaagaatgactctacctcgtatgcctgacaactgggctgcaatagcctttgcaagtaatttaaatgacaaaagttctgaagccacgagacgactcaaagaaagccttcgagaatttcctgcaaccacgtggaatgatgtttacaacaggtatagtacgaagctgcgaattgaagaagataccgtacctaagtttcatcatgaagaaaggggtggtccccgaagatcaaaaaccgaaaaaagatcaggtaaaaacaagtacgatccatatatgggacctgcaggaaaagacccacggtcgaaacaagatagccagcaatatgatcaaaaatcgaggaacatggactctggttcttcttcaaagttcaggaatgatcggaacagacaagaatcacgagatgatgacagaagtttaaaggcacgattcggtggatataattttaatgtctctacctccgagctcgtagctgttttatgaagcatgggagataaggtacggtggccaaaagagatgcggtcaaatccaaatagacgcaatccagatcattggtgcgaattccataatgatcacgggcacaaaacttcagaatgtagattcttgcagagtgaagtggatcatctattgaagcaagggtacctcactgagttatttagcaagaaaggaaaacaagcttatatgaaaaacaggcaagagccaccacaacctcattcacccaagaggacagtgaatgtgataagtgggggagaagatattcacggcataacctacacagcctccaacaaggtttctaaggtaacaattacacacgggaaacgggtgcggcaggtcctagaaaatgaaagtatttcgttcgatgatgcagataccgaaggagtgacaactccacataatgacgcactggtaatatctttacttgtacatgatactaatgtaaaacgagttttgattgatccagggagttctgtaaatattatactactaagggtattacgtgaaatgcaagctgaagacaaaatgatacccaaggcgcacaccttgtcaggcttcgacaattcaagtgtggtaacaaaaggagaggtaattctaacaacttttgctacgggtgttgttaaagaaactaaatttcaggtagttgatatggaaatggcctacaatatgatcatgggcagaccatgaatacacgatatggatgttgtcccatcaactctacatcaatttattaaatttccatcaccatggggaatttgccaaattcgtggggatcagcagatggctagaagtgtcaacgttgtaacaagtacgagcaccgtaaataaagaaaaatagcaattacaggaaacagttgaaggtaaaaaagatcaaacttcaactgaacaagaaaagacagatttggactcaaggcctgacacaattcaggaacctgaagaaaatgaaagcatcaaaacgacaattgaagagctcgaggcagtgatattatttgagcaatggcctgaacggaaggtttatgtcggagccaatttaagcttaaacatgcgaggtatgataatcgaatttttaaaagctaacttagactgctttgcttggtcccacgctgatatgacagggataccaccggatgtgatgactcacaaactcaatgaggacccttctttcacaccaataaagcaaaagaaaagaaatcaaggtgctttcaagaaccaggtgactcaggatgaggtccaaaaattattaaaaattggattgatccgtgaggtaaagtatcctaattggctagctaacacggtggtcgtacccaagaaaaatggtaagtggcgcgtttgtgtggattataccgatctaaacaaagtttgtccaaaagattcctttcctttaccgcatatagaccaactaattgatgcaaccgcaggtcatgaacttttaagttttttagatgcatactcgggatataatcaaattaaaatggatcctggtgatgaagaaaaaacttctttcatcacagacagggggacttactgttataaagtaatgccatttggtctcaaaaatgctggggcaacctatcaaaggttggtcaccaaaatgttccaagaacatttagggtaaacaatagaggtatatatagacgatatgctcgtcaaaacccagcgatctcatgatcatatttctcatttatctgttacatttgaaattttgcgaaaatttaatatgaaactcaacccagaaaaatgtgcatttggagttgcatcaggtaagtttttgggttttcttgtttctaaccatggtattaaagtgaatccttctcagatcaaagaaatagaagaaatccctgatatccttattaataaaaaggaagtacaaagattaacgggaagaattgtagctttggggagatttatttccaaatcctcagaaaggtgttttaagtttttctctgcactcaaaaagcaagatcattttgaatggaatgaagattgtcaacaagcccttagaaatttgaaagcttatttgtcaaaaccaccgttgttggcaaaaccaaaggtggggaaaaaacttctcatctatctggccgtatctgaagtcgtggtgagtgttgttttagtccgcgaggaccaaggtaaacaatctcctatttattatgtaagtaagtccttattggatgctgagacacgatacccacagctagaaaaattagcattagctttgatcatggcatctagaaaattaagaccttattttcaatgtaatcccattaatgtagttactgcttttccgcttcgaaatattttgcataaacatgaactttcaggaagattagcaaaatgggctatagaactaagtgaatatgaagttgtttatcaacccaggactgctataaaatctcaagtactagctgatttcgtggctaattttagccaggggatgcatttagaagcagaaaaagaattactagtttttaatggtgcaaacccggggacttgggttttattcactgatggttcatctaatgtaaaaggggcaggcctagggatagtcctcgtaccacctgcgggtgagactattagacaggctataaaatgtcattctataactaacaatgaagcagagtatgaggctgtaattgcaggtttagaattggcacgagaactcggcataacatagattataatcaagagtgattctcaactcgtggtcaatcaaatgttggggacttatacagccagagagacgcgaatgcaagaatacctcgtaaaggtaagggagttgataaagcaattccaaacttgaaaagtagtgcagatcccaagagatgagaatgtagaggcagatgctttagtaaatctcgcatctgcagcagacgtagcaaacgatacaaatgcttcattcatacatttatttcattccattctcgaatctgataaaaacgaggtaaattttaatcatttaacatgggactggagaaacgaaattgttgcctttttacatcacggtaccgtgcctaatgacaaaggaaaggctcacgcgcttcacaaaaaagctgctcgatattgtttatatcaaggaaatctttattgaaagatgtttagtggaccactagcaaggtgtctcggaccctctcaaacagaatatatgatgagagaagtgcacgaaggacattgtgggaatcacgcagggggacggtcactggtaagaacattaattcgcacaggatattattggcctaagatggaagaagaagcaaccagtttcgtgtccaaatgtgataaatgtcaaaggtacggcaacaatatgcacagaccagctgagttactacatcctgttatagccccgtggacctttatgaaatagggaatggatatcgtaggtccacttccacaagaaaaaggtcaggtaaagtttctacttgtgcttacagattatttcactaaatgggtagaagcaggggcatttaaataggtacgagagaaggaagttaaagacttcatatggcgaaatataatatgccgttttggagcaccaaaggagatcgtgtgtgacaatggaccacaattcattggagctcaaatcacagaatttcttcgaagttggcagatcaaaaggataacgtctgcgccataccatccagtaggtaatggacaagcggaatctactaacaaagtcattatcaacaacttgaagaagaggttacaagattcaaaaggtaattggcctgaggtgttacctggagtattatgggcttatcgtacaacgaccaaaataggcactggagaaacaccattttcaatggtttatggtgcggaagccttaattccagttgaaataggtgagccaagcacacggtacgatcaggcaacggaggaatctaatgatgaagagatgtgggtcaaccttgatttacttgaaggaagaagagaagctgcattgataaggatggaagcacaaaagcaagtaattgaacgatattacaataggaaagcacgcctcagatttttcaaaattggggacttcgtgcttaaaaaggtgttccaatctgcaaaggctgctaactcaggaaagctaagtccaacatggtaaggaccgtacaaagtccgtgacattgcgggaaaaggagcataccagttggagacaatggacggcaaagttttaccctcacattggaatgccgtccacttaaaaagattacttttgagaaagtacctacggtcaggtatcaccatgttaaaatttctctcttggattattaatgttttactaacgattttagatgctaggcaaaacaccctaactcgtgccaaatgatgaatcacaacctgcaaggcaaaatggagtattcttaaattcccagcccagggttacaattaatctgatggaaatacacacgagttaggcagtcttcatctataatcgcacctccgagtcccgtatatatttctgtttcaggaaaagggccaaagtaaaagaaataaacaagtgctcgaggcttcatacttcaccgctcaaacacttgggggactacatattgtacacagatacgtgtataagtgcagatacgaatatcgaacaaaagtcggccacaaagagacaagtgttgagaaaaagttacgaagtcttcagcattcatgagaacaacaaagtcatctctcaaaactcataaacaaagtcacctctcaaacccttcttaatatataaagatagggtcatgactatgtactgaaacaggttatgaagaaaaaccttgtttattctatgttatgtacaaatctgttataaaaaaacagttacgagaaagttgtagatgtattgtaatacatgtaatagtcaaacacttgttaaagttcatgaatagaaacttgccaaagttgtttcatacaaaacgtgtgtattcctatttctttcatcgtattataaacaccattatgaagttgagacgtcttcttcattaagtgtcgataaaataaaagggccctcttttataagcctcatgttgataatccatgagaagaatcattaagcattttaaaagaataaaaatgataagctattctataagtcctagataaatgggcaagaataaaatatacggaagtaccaataaaaacttcttaatataaaagactaagtacaaacttagtcagcaaaatatttgttttttacaaatgccccattatgataactggggacttcgtcaaaagatcccttaaagttgccaagggataacaccaccaattaataaaaacaaaaacagcaatttcattttcagctagtcactgaaggggttagaacatcagaagttgcaatttcattttcaagagcaattttaattgggcttggaatattgaaatcaccgaggggagcaagaatcacaggagcttcagcttccatggaaggtgtcatagaagtttcaccctcgggagccggaattgcaacctcaattgctgcagtagccacttcttcatttaaaagctcttccgttccaggagcttcaagtgcaggagaaggagtatcaataggttgttgacttttctcgatagtgtctaagactttggctaattcagattgcaaatcgaagctttcctgagcagcttccattagagcatcacggcgagatttcaggaaagcccaactcacctctatgttgaagttctcctccagaagtccatactccctttcccacatagcaagatcattcttcaatatttgatgttcagctaaatgggaatcaagggaagcttcaagggaggcatgagagctcttcaaagctcgaatctcgtcagaggaggtatgtaagtcagcttgagcttgagtcaagctttgcactaattctcctgcatattcttctttcttggctaaaagtgccttaagctccctgacttcttcactagcctttgataattgttctgacattgagcactccaaaagctctttatctcttttaaattggcttgaagaagccttggcagtcgctagttcagaagtcaaaccacgcttttgctgctccaggagatttctactttcttgcaactcctctatggtccccttagcattctcaaattgttctttccaattagctgcttcaagctgggctcccctggctatttcctcggcctcatggatggatttcttagactcacgggtttttctttccagaagggaaattcttcccatcaattcggtaccaataaggttagcctacagagacaactcatagaaatgaggatttgtatatcgaaaataaaaaacttgttggtaaaggaaaaatagcttcaaagtagaatgaactatgtcattcatcagagtcaggcagctgtggctctccatcttcttcttctcaatatcaccgattagaggctcgagccaaacatcagctctaccagtctttctcaaaaggttatggttggtaggaacttcaagaataacacttctcatagccatggttctactgctagaacccgcctctgtatgctgaacgaagggaggaggagccatggaatgaggagtagtagaaaaggaaaacacagcagcaggagccataagagtcaaagaagggatggaaggagaagatgaagaaactgacacaggaacggaagcaggtgcagttgaaactggcaaaggaatggaggaaataggaacgaatgaggagagaggagcttcatcaaaaacagggtcgggctcgccactctcaaaaccactatcaaaaagacgctgagttaattcattagtatcttttggcacggtgtcctcgtcagaatgaatcaaaacaggctcggtggacaaagtttgagcaggggtatcctcaatttcatcactattaatgactcgtctcctatctcttggcctggcaattaaagaggtatcttcctcttcctcattctcagaactttctcctatagctttcctttttggaagcgaagctcgagctttgttcaaatcaagtgcagcattagcagacatgcgaatggtcataactacttcagctgtcattcctctaacaccaaatcctgatcaaaagaaggatacataatcaacattgagaaaaaggtgcttggcatgtaaaaaacgtgtaaaaagggacataccatgtgttgtcaccttccagccatgtaaagaagaaattgatttccaagttctttgatctttaggagcaatcttcaaaattgaatcgaaccaaccacggaagttaggaataagttccacatctcccatggttgctacaaaaaaaccaaaaagagacgaagtgagaaaaagaatcagaattctcaaaaataggtgcggtaaataaaaggaaacttacgtgcaaaattccacttctcagggaagggaatatttgtttcaccaagaaagtccaccgtacgtacagcaatgtaacgggtgtaccatccacgatccttgtcatcttcagggtttaccaaaacctttttgcttcttgcagttaaggtaaaaaacccatggcgcattaaattgggatggtataaatgaataaggtgagaaagggtgaagtcgacattggctttggcagataagtatctcagacaagccactgctctccacactaggggaccgacttgggccaaacagattttaaagaaacgataaaagttaataatgactgggtcaaccggaggattaaaacccaaagtaaatgggtaagtataaacgaaagaataaccatttctaaaggaagaaattctttgatttggggaaggaattgacattcgtagactattgctccagttacaatcccttctgatggtagggattgtaagctcggttactaatgaaggataagtgtcagctttttctaaatttgcaatttgcctttgaagagacgttctatcactcccaaaagacaaattactgggaaaaatttcatcgactaaaggttcttgagaagaatcaaggatttctttacctttagaagaaggggtcttcggaatagaactcccgatattaggagaagaagaagcaggaccagataaaccatcacgagcggaccctaggcccaagctccgaagcctacctcctctgcctctcatatgtcttgtaggggcattggggaagtgatcaagaattggaacttttctagggttagggtttggagatgacattgttgaagaagggtgtactaaaagggagagaaaatacaagtaagtaagaaattgcttgttgaagatctatgaagaagaaggtaaacgaaaaagggttaaaaatgcttataatgacaaccgtcaaacttagaagtgcaatgaaggaaagcttataataaaggcaactatcatttcgtgaatagtgtaaatgaagaagtctcgaaaaaaggggtagaattgcagaatcaatcagaaggtgacacgtatgtaaagcattaaatggaagggacaattgaagcgtcagtatttgtcataatattaattacggcaaaaatttcctttttatgaaaatccacttcccaattatttacttgataaataaatggaagtggggggactatctgtattgggaaaaaactgaatttacattgtaggtgacgtagcatggcatgtggactggtcaaacggtcaaaacacaataaatagccaagaggcacgggtgacaacagataagggaaaaagaaagcaacattggtgcggaccgttactaaaataggtacgagtctcgtacctatccaagtcatctaaagaccgaagagcggaagaagttgaggatacgaatctgatgatgtaaaagagtttaaatatagcattaaatatcaaatacgttagaatatttgttttaaaaataaatgattgtgtaacgtttcttttaatgtcatttattgctcataattgcctcattaagacaaaggcattacctcttctcctataattagctataaaaggagaagaactcaccatctgtaaggagacgaaatattattgggatcttactgtaatacaaaactatttactgctttaccatcattctcaaaagtattttgttttcgtctcctgattatcagtaacccgaatttctttttagtcttgaccaaaaactcagatttttgattaaacaatatcatcaatggcatgttgtacggttaacacatgtcatctatgtcccagccaaatactaaaagttgatcgagctagattaatgaattctcaggtaaaaaccatttttaaaataaaatagtttctgagaaaaacatttaatctcaaatcacacacacccttaattccaaataaaagttgatagttttgaggcaaaacacattattaatgccaattatttcaccttttctacatttcactgtaaagaaatttcagattaataaatttcacagtaaaactgaataagaaaagattaatactttctggttctcgagttaaatttgaatgtcaagtatgtgctctatttttgtatttagaaatcatacagatatataactattactctacgagttttagaaaacactcagacgtaccttcataaactagtgtttgattgacgcttaccctcaaaagtgggatttttcggcataaatctggattaatcatgacccaaagcagatataggactacatcaggcgaaaaaaatcaaaaatatgaaaaataaattggtgtttgatctagatatcatcagaacttaaatgctataactaatcaaagttcaagtgatatataacacgatgctatatcatttttctcgtagcttaaaataaaaattgaaatagaaaaaaaaagtatttgtaacttaattctgaaatgggcgccatatcctaatcccgtccttttatatatagaacgaagaagcaactttacaacaacttaaactaacaatatttccctctacgacttctacaagtttagcctctaattcaattttcagccaattttctcttctttagaggtacattttttacaaatgacaacgaaaaagaagatgatgaaatctccggcgaaaggcaacgccgcctcggagccactctaaccggctcggatatgttcgagccgattaagtgagggaagttgagccgagccttagagccacggatcttataagcggcttggtcataagccaatgctgcatcttcgggtgtctcgtaagttcctagccaaagcctggcgcctttcctatcagggtttcttatctccgccgcaaatttaccccacggcctccgcctaacacctctgtaccggttccaatcctgaggtgcgtgcacaccacgcgccaccacatggttcttctttgtttcctccttgtactccaaattatcgactcgttgccacgtggtattgacactagttaacatatcgccccagctaatttcttctgttggagagctaccaaaactcgagtccgggctattaataatttctgcattactaaaacattgatcaaacgtggaatatatctgtgaaaaatcattatcgtttagaagatggaatttgatgttttcaaggacggagagatcagaatctgagatggttgtttgttcgtacatttcttcttctttttttgagttttaaggaatttttttgttttgctacaatgaagaagtttagaggtcagtactgtgaatgattgataaggtttgcatttgcattttatatagagcaaccacactgtccactattttaattatgtagatagaataatattatttgtttaatcgaacacatggtcttttcctttaattataaggagcgtaacttataggaatttcttggaagctacaagccaatcactcagagtagttattttgaacatgtgttataagaagtgctccattatttttttcgagcaataatttgtttttcctttctttttatgatttattatattttactctcggaatggacaacgcatcctttgtttagtatcataaattacgaacacctatacacatttgttaggaaatattacttgtttaagattattttaagaaatattacttgtttaaaattattttattctaacatctttcagaaactaaattagctaaaaccaaaaagctttcagttggtaatataatgcttttccgattcacagttgcttagaaaatgaattctttttctccaaacgattgacatttttttatttagtgggataatcaataaccatgcatgttcaatatggtaacttatttaagtaagacttgaagattttgattcgaaacaaattatagaagtattcttattcttagggaaaagttgatttaaaaaattgaaagccaaaagattatgacatgtgatgatttgaaataaaagaaatttgtaaagcttttatttaaagaggaataaattgaactcggtccctgttttatatgttaatttcaattttagaccctattgtttaaccagcacatatagaagttccatttgttggaaatcaattgttagaatctaacgagttgatttttccccttttctgtgctttactgaaataaagaaaggtagagtatctttcaaataaataaatatatgcgaagtttgagaatactaattaaaaattaactaaaaagtagaagaaaatgttatacagtgaatgaatattgtccccaaaaaaagaaaaaaatacaaccgtccaaacggatcagaagtcatagttaccagtcatacattcgtcttaattttctttacttaaccataacgtgtatttggagtcgtgcaaaaaaattaaagtcaataaaaaggagattggtcaaagtcatcagttggtacactattttatatatcctccgtacttataaatatacttgtctgctgctaccacatcatagtcgaagagcaacagttctaataaatgtactattaaaatgaaggcagaatagccttatagaccaatgtacttggccgatccgtgtattctataaagtttcatctagacacttatagttgctaaaatacattatctgatccgtatattctataaagtttcatctaaacacttatagttgctaaaatacattatcttacacctctctgaccctgcgtataatatctacctcagataaaatatgccacatcatttttttttattttattaaaggcaaaatgaccaccattttcaccttcttcaccctccaacaccattgtaatattcagtcaccttcccagttaaaacctcaccatcgaaccacaaaagaggtactagcaaacatcaaaagcttgtttttttcttacctctacctctataaacaaagaataaaaagaaggatttgtgaataaacaccacaaattttcgagggattgaaagtgggagaggaagcaattgaagttgcaatcacttcaaaatctaataattttcacaaaccaagcaattgatttgggtacccacacgctattacagattagattcgggcaccccatatctttcttccttctttatgctcttcgtatcctttggtattcttcacctgatttgacttgaactgctagggtttctctttttttgtatttttttattttctacttagaagggtgatgtggaagaaataattgtggtggacattgtattgggaaaaaactgagtctgaatattgaagatgacgtgtcatgacacgtggactggtcaaaaggtcaaaacgcaataaacagccaagaggcacgggaaacaacagatagggggggagaaaacaacataggtgtggaccgttactcaaataggtacgagtctcgtacctattcgagtcatttaaagaccgaagatcggaagaagttgaatatacgaatctgatgacgtaaaagagtctaaatacagcattaaatatcaaatacgttagaaaatttgaattaaatagaaattattgtgtaacatttcttttaatgtcatttattgctcataattgtctcattaagacaaaggcattacatcttctcctagaatcaactataaaaggagaaggactcaacatctgtagacacacgaaatattattgagattacattgaaataaaaaactacttattactttattattctcaaaagtcttctattattttcgtctccagattatcagtaacccaaatttctctttatttctagctttgactaaagactcagatttttggttaaacagtcatcggtggtctccgtcgctggtgatggcgaacttttccagtgtgttctttgtcattgatgattcagaagtttcaacactagccagcgatgattgtttgacagactccgatgaaattcttattcttcttgatgttgttggttgaagttctttttgcgaaccatgagctcttagctgatcttgtctattggttcatcttttgttgctctttaattatgatgaaaagaaaagctatgactacagcaacaggaagagaaccatgggttcttcgtcttttgtgttttctttttttcttttttccccctcttattttagtcattttctgtggaatccttgtaatcacgctctttttgtgtgtgtaccaagcattttatccacctcagtcttacctatgccacatattctaggtcaaccgtcagagggatgtaagatagtgtgtttagcaatgtaagtatctaaatgaaactctatgtagtataggaaccgagatgacaccggaacaaatacaatggtctactgagctattctgcctaaaatgaataaagaaaagaacaaactaacctctatagcccctcaaaattttaatagctcatgttttgtcctacttacaaaaaatggcccttcggcctaaacgtattgcatatagtagccgaaaagaataaacatgacgacacaagcgcctgtagctcagtggatagagcgcttgtttcctaagctgaaggtcgtaggtttgacccctacctagcgcgctagagcaacccttttttgcctttttaaatgtacttttggatccgataagtattagctaacaattgaatgaaatatgtaatgtaggtcatatacgaaatgtctatttttgtatattataacagtctatttttgtatatttttgtataataacagactatttttgtatattttttgcatagtgatagtctattttgtatattttttgtatagtgacagtctattttgtatattttttgtatagtaacaatctattttgtatagtgacagtctattttgtatattttttgtatagtaacagtctattttgtatagtgacagtctattttgtatatattttatatagtgagagctaattgtatataaattgtatagtggcagtctatttagtatatttttatatattgatagtctattttgtacatgttttgtataatgacagtctatttagtatattttttgtataatgacattttatatttatatatattgtatagtgacactctatttgtatataaattgtatagtgacagtctgttttgtatattttttgtgtattgacagtctgttttgtatagtgacaatttattttgtataatttttgtatagtaacaatcgatgttttatatattttgtaatataccaatattcaaatctattttcgaaagaaatatataaatatccatgtaaatatatactaatggtgggcctaaaattataattcccatcaaaatcaactaatgacatacatgtggaaatggaaatttatttggtgaaacccaaaggattttcctagcaaagaaagttagcccagaaaaaaataaagcaataacagagagcttggaatttttattcaaagagtggttgcccctctctctttagccaatgattttccttttccactttttaaacaaaaccaacggcccttgaattcctgaaaatacgtactactatactgtcatttcttcggtatcaatcaacaacagccatatctctctttttgtctctgtttttgtgattttagttcctttttttggtacataacaattgaggcagtgatgatattttatctggattctaagctaattggatcgagcatatagattatccaactcgtatcttggcctggcaaatcactggacggcaagcgattcaaaggttttttctttggatgcaatcggtgattttgtagccatagcgtggtcgcctctctttttcgcgatctgtctttacagatctgagcctcagtacttttgggctagccactagaattatttttggactataaaatgtatgttgcagtttttgggctaccgggtgaaatatgtttgggccgatgggctcttaatgaagtttgctctaaagaaaacgcctgctgatttgggctacctttggatcaaaccttttggcataatacttaacgaataatcttctacctttgaaacttggaaattctttttctttttcaggctttctttgatgttgtgtactgcaagttgtataataacacgccaaacaaagtagggtttggacaaaaaaaaaataagaattctaaaaaaaagtagcttttgaagttaagttgaaaaattatatttggaatttgaaattgtattcgacatgcattttactagaaaaaaatgataaagtttaacaagtgaaaaccaaattttcatgaaattttcaaatttaaaaactcattttcaattttttttgaaactcatcttcaaaaatttaattaaatgtataaccacacatgatttgaaaatattttccagaaaaaggaggggaaattatgtccaaacggctcctaaattaaacattaaaatccaactgctatactcaaaaatataggcgggaagaatgcaatcccctgactaataattacatctaagacaaatcaataatattgatggactaatcgttttatccttcttactttttggtcctagtctaggccatagagttcatcaacctaccatcaaagccctcactgttactcatagtataccacattatgaagattaacttttatacaccgacactgtaaaaataatttacatatcagaatcttaacctattgtagcaagcaaactactttgcttttaatgttactgatcttgctttagttatttagatgactagatagtgtaaatcagctgctcttaactacatactctcaggaaatttttatccatctacagcaaaaagatcctccacctatgaatatggcattacctgtatcccatatgcaactttgggaaaaatcatgaaagcatatcgacttataagaatgtaaaaggaaatcagctccacaagtttcagccgcatcatcctatttgaagatcttaccaactcaaaggcaaacaagatgaaaaataatggagttcagtacaaaatatatttgagtctacaagttccattcacggcaggttaaactttaaagaggtgaaaccatccgctaaagcacaaagcatctatggtcggaatgctatcaacaaaaaaactggccatgcagcctctttaattcatcctaacatagccctactccatcaccttaaccaatagggtgtcgtctcctgcaaattttacaagtaaaaagatcagcagacgagagacaattctataaagatttaagttatacactaacaatataagaaatctttgtggattctaactaccttactttccaggtttactaattctacttttagttacagacactcacctgtagtgttatctcttaggtgaccttataatgtaaaaaatacttttacacggccagtgtatagatgttaaactcattctacaatttgaaagtaaaggcttccagggtctctagcagtcaacacgcatgaaacaatagatccaaatttttggtttgaagcatctttacaatggcattggaattgacttaagtgacccagcagtccccccgccccaagacactataccccattggctgcacttacggattagcaaataataggacttaatcagatgttttaatatgacatatctcacaggtcaatatacagaccatgactagctgctaaatgactataaagtttaatcccgggaatattagactactactacctcttcggtcgacctcggtcctcctcataatccatcactccaccagattcagagtagatctcctcatgccctctgaagtcaacatcggcctgcttacagtttgtagcttctgccacagagtaagtaagacacatcgacaaaaatatcccagtgcttaattataaaatgagtcttcaacataacgaagtgcttaaatatgaaatgagggttactaagactcaaatgagcgaactactaaggcattctctacccaaaagaatcacatcccaggttgaccaagcccatcctatgaaaggcacgatcaccaatggtctggtgcattgtggaaagcccatttatggtttagaattaacagagctcatcttttgaaacacaatacttgactcaccttcaaagagagtgacttcttcacttcgtcaaccctttcctcaacttccttccggtgcttcctgtcagattcactcattgtatctgcccatttgattttctcttgaattgagataagaagattgtctgatgtagtcaacctatgtttttcatcaaaaaaaatgaaatgaattagcaagtaggttgaaaaattacagttaaatttcacagctttttttaatcatcatggctatgtctcatagtttgcatgggaaacattcacagttcacaaggccctcctgtaagaggcatacaccacactgtacagaaaaatgtcaaacacctataatcttatccctcgcctaactacggtggtatacctcaactccacagactcaatttacatttgatttatggcttaaaaagctgagtgggactgtactcagtaagtcagattatcacataatttcagccggcagttactatttacattgccaaaattgtgttgttcatagttgcaagaagaacacacatgtatatatgcttatcgagaaaaaaacaagtatatataaccattgtgtaaattgacatgaatgaatttggcaggatgccttcattattagctcaaataaaatgtatgatcatcttgacatgatgaataacattgacaaaatgatgtttccaaaattggggtccaagatggacttgttaatgggttggttcaaaggatactaaccttaaaaccagaacaggtaaggaataatatgcttctatgtcaaaaatggctactaataatgggttaaaatctagtctatattcctaaactagaggacagagatccatcacctaggaaagtttgtgttgaccgctcttagcacaactttgtgtcaaacatgacctgaggacatgttagacacaattcattcttatccaatttcttgactactaaatcattcaacagacacaaggactccacaaggactcatccaaacataaatctgaactaaacaattttttggtagctagacatggaaattttggtagaaaatagaacccaacatgagttccatcacctaggaaattttggtagaaaactagaggacagagatccatcacctaggaaagtttgtgttgacagctcttagcacaactttgcgtcaaacatgacctgcgcacatgttagacacaattcattcttatccaatttcttgactactaaatcattcaacagacacaaggactccacaaggactcatccaaacataaatctgaactaaacaattttttggtagctagacatggaaattttggtagaaaatagaacccaacatgaatgcaactaagttacagaaaaagccaaagaggaggcgcaaaatgatccaatgagataatgacttgttgcatgcctccaagttcgctcaaattaaagtaccccaaaaacctcattctaccttgttttcttttgacattttcaacaaccacaacatttcactattggctcttcccttgaaaagtcgaacacctttctacttttcaccttttcaaagcaaggagcagaattcccagaaccccacaacatttccgcactggacagcagggcccaaccttttcctcctcctgtttggggccaagatctttgagctactacaccagcatatgcaatgctgcctgccttaccttctgcatttcaagctccatcaataagacaacgaactgatcaaaggcaagaccccccagccaaaaaccttcactctttcttcaaatctcagtcttcattagggcttttagcccttgatcgatcgagggcatatcactcctagtccagaagggaagagcttgtttgcgacaagcagtagctggcaacggtctttgacacatctattaggtaaagaggcctaaggctggtctctttcctctcataccatgccagttaaaagttccttgccttttcccttcaaccgtgtatgaattcctaaatccatttacctcgaccagcataaactctttttatgccctaggaaaaagctaaaagttagtcattcatcaagccagagcaagtttcacagctaccgattctcggccgtgggtcaaagaaaacaagagctttttgcggggaaacttgcaagtacagtttggggggagggggtgttgacctaccttatgagtattcagattgtaacagttccaatgaacagtcactcacttttgacatcttcatgtttaatcttccttaatcaaatctcagtcttcaagcctatcttcctgttttcatcttccttaatcaaaactcagcctttaagttttctgcccatcttccttaatcaaatcttacttcaataaaaaaaccgaacctccactggaaactcatgtcttcctgggaccctggttgtctatccatatgaggaaacacctcccccctaacttactatataagagctttaccagaaacactgcaatctacatatcctatcccatagtcctaaaagattttcttgttttttaccagcagtgctgaacttcaaataacagcaactaaatctctatatgccatatgctcatcaataatgtaggtcaacaagaatggcatctccataaccaaatagaaacaggctgcactcgcttttcttaaaaagggaaaaagaaatgatgaagaataaagaagaacgataaaaataaggtgactgaactcaactttttcactaactgcttctctgcccttcaattattaattgaagagaattccttcatcaaatgcttattcaatctactaatagcatctacttgtttatttctcatccggtgatagatatacataattatcttatttaggtacccagcattgaatttttttcaaaaatcagagcattcttttttgaactcaggtatcctgctttgagaaatttaaagacttcagcttaatttttttctgataagtaagaattctacttgaaattacatagatatgtttccattaaacaccaagttcttataagttaaactggaaaaatggcaagatcccataagcaggtgtaactcaaatcactcctatagcctagctgactgctttgttttaagaaagaaagaaaacatcagtctttacaaattgcagctcagtaagtcattatgaagcacaggagatcaagacatggaggagaaatacagaaaaagaacttcaacaacaacccttaagaccagctatttgtggacagaagatgtttgctgtataaataggacaacagaatcttgacaggaaggatcaatgcacagccaaagcccacaaagaaataactaaataatatactcacactcagaaaatacgataagatacaatggcatcgcaattagacccatctagataaaagcataaacataaccccttttgaagggaaaaaacataagcataccagtcagttaatgtttgtagcatattccccaattgaccaggtctgagatccctccctgcagcaaattgtacctatagttgtatgatgacagttaattaccctatttcagcccattgcaaccaagagttggcaaaacaggaaaagcatagtaccaacctcaaagcatcttttcaactgatcaagctttcctctaactatgccctatccatggatacagaaagatgggagttagtgaattttttaacaagagcctgaaacattaaatcaattattagcagcaaagcgcccccccccccccccccccacacacacaccccaccaaatcgccccaaaaaaaagggaaagaagtgaagaagagaaggaataggaaaaactagggccagaaataacctatgaggcaacagaaaccacattaaaagattgagttgaacttctatccagaaggcaaaaaactaccacttgaacatcagcagaagcaaattccaacaataaactttagcccaacacactttcaatagaggacggtacaatggtacctccattaataacacaatgatccagggatgagaggtgatactcaccacatacatgcactcatttatgagaaaatcttcaagttcacgcacatttgtgacatccaactcctgcataagttgatcatatggaagctcctggaaagacgaaaggagtcattattggcagtgactaacaacaaacggtatcagtgaaacaaaagtcaaacaaatactcaatatgaatatcaaaggttttgatatatgaacaggttatagtgaagaaacacaaaaaaagaatgtcaaagactcgaaaaaataatgcataaaatttattctattccgctatgagaaatgtacttgagagaaatgctaatcatgcaagtcgcaggagacatctcatgaatagtacgatatatagctgttgacattgagcaaagtaggcatataacaaagtatcccattatttacttgaatggcattatttgagtcatggccaatgatgtactttattatagtgggttgaagtaacactcaaatgttacacagcaacaaaaagaaggaagcaacaatgaactcattcaaactcagggaggcctaagcaaaacaactttaagaatactgattcaattcaacgtcaatgtcttaaatttaccaataaatagattgtatccattatcctgatcaggtaccaaaaacaaaatttcaaaagctccaacaaacaagcaccagaaagctaagacatttctctcattcattacaagcttcatttctgaaattttagcaataaccaactgaagaaaggatgttaataaggatgcagcaattgctcactttcgccaaaggataaattacaacgccaaatgtttattacatttcaatatactgtaccttgcttgtctcagctagcgtaagcacagtaagctgcttcaacttgagaacttggtcaggcaccaactgaggaagacggccagcaatacctatagaaccacatacatgctaaaactgacaaatttgaaatgcaggtaatatagaactccggagtacatcatcttcctcttacaagacaaccctcttcggtaatatgttcattggcaattcacaaacgatattttccctaatttgtatgtttagcacttattgcatatgaaattccatccctttcacactaggatcaatagaaggaaatcactgctaaatgtgacacttgtcactcaagagaagtattaaggtaagtgacacgagcactggcatagttaaggatgtaacagtgttacttacccatgataatgaaaagaattcacagcagtagaaagggcagctaagccatgccctaatcaactttctagccagtaatatactcagttttggagatacaacattgtaataatgtgatgtttaataattagaagaatcttcaagatattatacagatggaaaaaatagcatagtcttttagagtcaaaaaatatctcaagctgataaggtacaagttccccgtactataaaacttaaggcatttaatctgacagcgggcagatgaagagttacaaataaaatggcataaaagcaataaaaagaacttttccttataaaaaacagcataaaaagaacattgttgaaatctcaaacatgaaaacctcatccaatcagctactcaccgtcccaccccacccagtaaaaaaagaagtgaatcagatgcaaaaatgtatgcttacttttgtaatcactccacgttccatgagcaaacaaacggagcaaatcaaggtatattgaattttcagttccttcaagctgcatacaggtccaacaaaaaaacaaattagcagcaaatgtgaaagggatcctaaagtgtacataaagcaacaaggcaacagagagttaccaacacaacttgccaatagtatatcaaggtgacttattcccagatttatatctaattgacataaaaggaactctaaagagaatcacaacctgggataatacccatctcaatatgcttagggcctaatgctctgaacttgatgggattgggaggacaaatccaagttgtttcctcaacaatctactgtatccactatgcttccttaacctccactaaaatttgttcaatttcgtagtatctcgattctatttacttccactctgcatttcatgattttcattccttttgtctctgctggggtttgattccaatattcacttacttggggttctgacactacatgttctttattttctactgacataaagaaagcacacagaaaaccagcaagtgattcaatgtgacatgaaaacccagtagccaaattatcagaaaaaatgccatcatattctagatattaccaaagcaataacataacataaacacaacacaatgtgtactgtaaataccacgaaacctagaaaaaaacacagaaatacaaacagttcgacacaaaaccgactaatccaaatcagaaaaataaaatataatcaaatcaaatcaatagcagaaagaacaagcaggaacctcaacaacgttgggaacagaaagaatctcggagaaagcgaaaagtgagggatgcgaagtggcttcactaataacgttgttaagggcagaacccttgagcgctgatgtttgtttcacaaagtagtcgatgtgctccgcttgcttttgttcgatatccatctctcaagggatttgaaattctccagacaaattaaaaagtattaatcacaaaaaatgtcagggatgattagggttcaattacatttatatagaagaaaaatattagggtttccgaatatagtttatttctcgactgaaatatttgagtcctggcagaggaaggatcaaggaatgaagctctttgttggtctggtaatctgattttatatgatgcgcccgtcgatggtcgttttacttaggtgggctttggatattttttttggaaatatttttcaataaaactgaaaattctgaaattattttaagaccacttaagttctatattttctaaagttaattgtgaaaccgtattagaagtttacactaataagcatttggaatgactaatagatcaatacagtaacgtagagagattagttaatattgtgatattgagataacaattcatgcacacacattttatgcaaattgatttagagtactgttggttgggatatactattggccatgcgttttagatatagtattatgctttattctttatgaaacaattatttatttgatttatttaattcaataaattattattttaaatagatcagttgttacatgtatgtcttttagttatgtagtagacaatttagtgaatggagtcttagctcatgcaaagaagattaaattatcggttctcataattaataaactatgttcacaatcaaagatattgttgggcaaaatatcttgatgattgtagcacaagattaaagtataatttatcttggttatgggagtggttttgctccaacttcttgtgctagtatacttagtgtatattgaacagaccaaatagcgaaaggatgtttttgtactgaatatatataaaacatcttctctaattcattaaatgagcttatactcctaatcttgatatagttattatgatcaatgtgatttgtttattattttatttatcaaaaggtacaactctattcagaattagtgtatgcctaatagattggacaataacggatagcaattgtaaaaaaataatgaggtgatagaatccgtgattcggttttgagtttgatgacacccctttatgtaagcttataaattttcatgtgaacctggccggtgaattttgtatccgtcacatgaaatagtttaagcggaattgtaacggatttaattagttgattaaattaaattataagtgatttaatttaattaactggtatttgtaatcttaacatgaggagttaaaataagcattaataaattttgaaattcatattgaggagttcaattgcagctttttagtggaataaacagcgattaattatagtaagatttaattcatccgaatttcgaattaatactatattttgtagcctcttaatgtttttgtggtccctgctatacctagtaaaaacctggacagacttggataaaaaagtggcttgggtgaaaagttatccttttggagttagagtacgattctacttgcactagcagaattcaacatgttttttagccctttttttgcttaattgtgggtctacaaaaaggaagactagtttcacctaataactcactcttcagagttatatttgtaggatataaaactagtcttgaagatttaattgtaggcaaaaaagactagccttgaagtagggggtatttgtaggcatataaattttattaaaattaaagtcataaaataatttggactatatttgaattcaagatatattggtccaaataaatattatgggataatataatcgaattaattatataatctgatatatatggattaaataaataagtcttaatccactaggctaacccatttaattgggctaaagtgatgagttcacttcattaagcccaagatgtcatcttattagaggcccgatttggtgtcacgtgtcaaatgacgtggcacgtcaagtcaaccagaagagccaatgggatcatgccacgtgtcaaaatgacaaggcatgccaagtcaaattaaaaggccaatgaaatctcgccacgtgtgcaagtgacatgttctaaccaatcaaatgcggtcttgtcccacttcaatatgattagtcagaaatagtttgttctcaccacaactcttccctcccacgactataaatatggatctttataactcacaaaaaggactagaagttataacaagaagacacaagggagctcgtggatcaaaggtcacaattctttgcaaactgcaagtgttcaagcattcaagcacttcaacacaaatttcaagtattcaagatcaagaacgaagtcaaatcaaatacaaggcgttcaagatcaagtctacttgttcgtgataaaatttgtggaacaatcaaagcgttcacgatagataaatcaaattcaaattcaagatcaagctcaagctcaaaaggcccttgaatttatattgagaaagaagaatcagaggaatcatggagattataacactcaaactatttgaaataaaagactgcgattgtcgcaatatttttcggcctcgattattttcttgacgcaattttattgtctaaaaattctggtacgcccagtgggacaatctctacctctcatctcaacttttcaatcaccaaagttcaagaacattgaaatgtcttcaaataaaaccaactccagatcaacttccacgaaggttgctaattccaggttttatgttgatgttgaaagcattctcgatgttacctttggaagctttggaccaattatgaggatcaaagcaagctctttagaataacaagcactccaagtgtcgtctgcatcaacccttatttttggatctttatcctcaaaaggagcaagatcctctatgaacgtatccgaaggaggaagcgatattgctgaaaagattaaaaaaactctagctctacttgacctctccggatcccagaactctgttgtgaaggaagatgatgatatttcaagtgatggatctttcccacttacaccatatagcatgagccattcgagaattaatttgtgtgacaatccatacaactccccatcatccacaacaatcatgtaaggcatggtgacaaacacttcatatatggaggagcagttggcaaacttgacggaagcaatcgctggcttgaccaagtgcatgcaaaatcaagatgctagaattgacaagttaacagacagggtaggaatcttgatggaagaagaatccacccatgcacttggtaagctcctagaggttctagagagtaattctcctccaagacaagtagcatccgcgaaggctatccctgtctcatctgaagggatgattccaatcgataaactaaagaaattcattgaagaaactattaaaagcaagtatgaaattgctaccaagtcctctcttacatacgcaaagccatatactgcgaggattgatatgttgaatatgcctagtggctatcaacctccaaagtttaaacagtttgatagaaaaggcaatccaaagcaacatgtggcacacttcattgggacatacaacaacgctgggaattatgaagattacctcgtcaagcagtttgtctgctcgctaaaaggaaatgattttgattggtatacagactcgagggaggatctattgataggtgggatcacctagagcaagagttcctcaatcgcttttatagcacgaggtcattgtaagcagaggcggacccaaaacttgaagatgacgggggcactattaatagagaactttaccaatagttcttgggtcctgccggatgtcgcaaactttcggtaatgactgacatatataagtaagttaggaggtgaagttgggtatggattttgggaaaagggaagagagaagtgatttagagcttttaaggttgggatttaatcaaaacaaaaaacagttgaaaaaataattaaaagaaaaaaaaaagaggtttgggggggttgtgaatcctaatctaaaaacggtaagacataaataaatgaaaaatctaggctacagttaatatttaagataaaaaggaaaattatttaaggaagtaagatagtccagattcgaaccttggacatcccacatggaaacagaggtgagtagcacattcgactagtgcccccagcacgattttgtgcttcagggtgcctaattaaatataaactcgtttctcaaggtatatatacagaattttcccaagattttcggggtcctgtgaccccctaccatccacgtaggtccgcctctaactgtaagcatagtggaacttacaaatactcgtcaacggaagggcgaactagttaccgactttatcaattgttggaggaatgcaagcctcaactgcaaagacaagcttagtgaagcttctagcattgaaatatgcatccaaggcatgcattggggactgcgctatatcttgcaaggtatcgagcctagcacatttgaagaacttgcaactcgtgcccatgacatggaattgagcatggcctccgctggaaataaaaggttgcctatctatgagcctcgcaaatggaacgacaagcaagaagtcaggaaatggagcaagtttatacccaagtctaaaaacaaagaagctatgagtgtcaacacatcccatgcgaagttcacgacaaaggcgagcaagaagcagagtatgaagtccatttctttccaagataagccaagtggaaagttgactctaaaagaaatgcaagagaaggagtacccatttatggattctgatgtgcctgtaatttttgaagagctactcgagttaaatctcattgagcttccagaaataaagcggccaaatgaagttgggaaatgaatgacccaaattactgcaaataccatctacttgtgagccaccctctggagaagtggcttgtcttcaaggacaaagttatggacttgactcgtgaaaagatgatcatgcttgaagatgagaaagcaagcttaaaccaaatttctataacctttgtctcattcaatccagatgaattatacagttttaaagaaagtaaagatgaagaattactggagaataacaaagcggaagtagaccaccatgatgatgatgatgaaggttggacgttggtgactcatcgtaggcaccataaaaggagcctacgaaaagaatcaatagaacaaccaacaaggaaaatgatgatgaaaagaccaaggagatggaatccagttaagcatttgaaaaaagcaaaagtggaggtgcatcaccctcagatgccacaacatccagtgaccttggaagagtccttgccaagttggttccgcgtgaagatttatcgtgatggtattgaggcctcttgttgcaatgttgataaaggggaagaaaagagtgatgacctaccgttggcaccatcttcagaaaagctcatcgagtctattcctcaagaagttaatgcttgcaagaaaaaagttacattcacaaatggcactcttctaccaggagacagtactcataaccgccggttgtacctggttggctatatgcgtgatgaaagggtgaatcgaattgtagttgataaaggattctcagtcaatatcttgccaatttgcattgtgaaagaacttggtactcccatgaacgaactttcagaaagtcatgtcatgattcaaggattcaactaagggggcaaagagccataggtgcgatcaggttaggaatcaccattgaagatatgcaatcaagtgtgtggctgcatgtgattgatgcaaagacttcatacaacgtcttgcttggaaagccttggatatatgagaataaagtggttccatctacctctatcaatgtttgaagtactatgagggaggaatcaagaagaagatagttgctgatgacgagccattcaccgaggctgaatcacacttcaccgatgcaaagttttacttgaagaaccacattgtgaagaagctaaaagctgatgatgtcataaatggcaagaatgatgagtccacgactaagagagctgcagtggttgccgacaaaaccaaagatgttgctgaggaggtgcaccctagctcaaataaacctcataaagggaacatcgtgtctcacagcaagaaagtaactcctgctctccactatgtcactaaaaagaagaaagaggagggtgaatcatctaatctccaaaccaacattctaagggaattaactcttccgatcaagcaaattgaggcagtaaagctatcctcaacgctacttggagggtttgtcgcctaaaatcattctcagaatgtggttctcccaatgagccgtcaaatttagggaagctcccattagaagttgatacaaggcaaccacgtgaatgtttggaatacaagaaacctccgccagttttcatctccataagaagaaaaatcaataattatatcagtgtagaagatgaatctgttgcttctaatagaccttcagtctttgatcgacttggaaagccaattgcgaggactttcgtatttgagagattggttatattaaagaatgggaacaagtttcatagaaattatcgaaatacaagaacacccatttcgcctaaaattcagaagatctctaaggatttccaaagtctggttccttctagaatgaggcgacagacgaaacttgtggtttcgtgtgatgaggtacttagggtgaagtcatacaatgtggtatacactaggtaacatgacgaagacgaagaaaatgtaggtaacatgacaaagcgagcatggcgttttatctctaatggaggatgacgagaaattcgaggatgtttcaccgtgttatcatatatccttcaatgatgggtaccctcaagaagatgaagatacaaaggatgctccgcctgaacttgaagaaggggtaaagccaatagtggacactttgaaataagtaaaccttcgcactgatgaagaaacgaagcccacgtatctaagtgctttactagcaaccgatgaagaaacaacttatatggagttactcaaggagtttaaggatggctttacttggagttacaaagaaatgcctggcttggaccctaaagtagcagtccatcaccttacagtcaagaatgatgatcgtcctgttaagcaagctcaaaggcgttttaggctagacttggttcccttgattgaaagtgaagttaacaaactcattgaagctgactttattcgtgaagttaaatacccaacatgggtcttaagtatcatccctgtaaggaagaagaatgggcaggttcgggtgtgagttgactttagagatctcaacaatgcgtgtcccaaagatgaattcctgcttcctattccagagctgatgatcgatgctactattggttatgaggcaatgtctttcatggatgttttgtcgggctataaccaaatatttatggcaccaaaatatgaagagcttaccgcatttctcacccccaaaagtatttattgttacaaggtaatgccttttggcttgaagaacgctggagctacttaccaaagggctatgcagaatatctttgatgaccttctccacaagaatgtcgaatgctatctggacgacttggtggtaaaatcaagaaagaggggcgaccatttgaaagatttgagaatggtgtttgaattgctttggaggtaccaactaggatgaatccattgaaatgcgcctttggagttacttctggaaagctttttggtttcattgtccaacatcgagggatcaatattgatcaagccaaagtgaatgccattttgaaaatgcttgggcctcgcgatattcatgaattgaaaagtatgcaaggaaagctagcataccttaggaaattcatctcaaacttagctgggaggtgccaaccattcagtcgcctcatgaagaaaggtgtccctttcaagtgggaccaagcttgcagcaatgcctttaaaagtatcagaacctacttgatgaagcctctagttttagcagcccttatacctgaaaagccgttgatactatatatttcaacacgagaaagctctattgaagcgttgttggcccaagaaaatagtgaagggaaagaaaactcgatttactacttgagcatgatgatgagtccaaatgagctgaattattcgtcaattgaaaagttgtgtttggcgttagtcttctcaattcaaaagttaaagcactagtttcaagctcatgttattcgtcttgtttctaaagcaaatcccatcaagtccgtgatgtcaaaacatgttcttagtgatcgactaacgagatggtacctccaatttcaatatttctgctacatctcgtgtttttatacgttaaagtttcatcttcaattaatcgacgtagactcggggatgagatgttcttgagattataagcattaggctatttcaaatacgtggtgagtaaattcgtgaaggaaagaatgtaagcaaataaaataaaatgagtttcgttaaaggatgtcgatttgggataaaatacagaccgagcgataatactcgatatttatggactagtaccatacaaggtaccatatgaccgtgatagtatgatgtataaagtgtattaaaataagtagaatttttaagtaatttgagacaattcctaattatgcaggtaattggttaattaccgggtagtgagatattacctaattaattaattaattaattattggataatattaaaattccaccccaccccatgtggcagcaagccactaaaccaaacaaatgactcttagtcatttttggttaagtggcaaaataatgtattaagtgcaagacacttcattcctattcttgaaaaaaaagacttaaaaagtagtgtgttatatacaaacacttcatttctcatatttggatacaaagactacagaacgctagaaattctttctagttttcaacaaggcttcttgcaaccaaataattccagcaagaattattagaaccttagcttcgtgatccaaataacgatacgtaaatgtaatattattccataagtgatcctactcttagtagttaagaatttctatgttattcattccgttaaagtgagacaaaagtgaatagaacaggatatgataattatgcttaaaggagcacataaggagggtgaatgtgatttgtgaatattctgtggcttttatataatgcaagttaatgtttttcctttatgcattaaccaccgagctacgaccggtcgggcagttacacatctaccaccgagctatggccggtcgggaagttatgtattattatttaccaccagttaggcagttatgcatttaccaccgagctatggccggtcgggcagttaccactggtcacttgggcagttaacatcataaaaatgaggtaactagaacaattatagtgtagttttatttatatatacgagatgggatttaatctatatgttacgacccttattggcaagtcagaagttataagttgactcttatctctccccgagatagtattttattattattacgtttcattgctgccttacatactcggtacattcttcgtactgatgcccctttttctggggcactatgtttcatgccacacaggtgtaggcaggtgaggtaaggaccatccactgtaggctgcctccagatatcagcttttggtttgtgagctccacattttcctggagtattgctgagtcacattctatatatgttactttgttttatgaggacgtcggggaccctgtcgcgtcttatatgttatggtcatattttcttagagattttgcagacattgtcctgtgtatagctttaggtatgacatgtcaactgccttgtcggcctctatgtatctacataaatctttttgaattagataagtgagttaagttctaatactattaattaaatatataaatgtggcctatcatggcccatgacgagtcttatagagaaaaaaaagataaggtacgtggcgctcggttgagtaggcatcgggtacccatcgttgccctctgacttgggtcgtgacagatttgagattgtgtacgttcctcaaaaggttgtaaaaggacaaacattagcagacttcttggcagatcatctgatatctgatgattgggaactaactgatgaactacttgatgaagatgcaatggtcattgaagtacaacctccatggaagatatactttgacagtgttgcacatcgcggaggagccggtgctggcatagtattgtcacttctcaaggggtggttctgccctactcctttacgttgacataactctgctccaacaatattgctgaatatcaagcactaatacttgggcttgaaatggctgtcggtatgaaatagttgcaattgcaagtctttggtgactcccaattagtgatcaaccagcttttaggaagctacgaggtcaagaaacctgaactacgcccttattataattatgctaaaaaattaatggtatgggttggtgatgtgactattcaacatgtacctaggaaagaaaacaagatgactgatactttagctgccctagctttatcgttaaccctgcctgatcaaacgcaaattactatctaccaaaaatgggtattaccgccaccaaatgagggtgaaagtgaagataatgaactcgaacatattgtcgctatttctgaagctgagaaggaagaatggcgacaacccattatcgactacttgagctatgggatgctcctagaaaatctgaagagaaagactaaaatccgtcgtcttgtgacttcctttactacaaagatactttatatagaagatcatttgagggagtacttttgcgctgtttaggagaagatgagatactccaagctttgcaaaaaacacattctgtggtatgtggatcacatcagtctggaccaaagctccacttccatataaaaaggataggctattattggccaacgatggtaaaagattgcttggactatgctcgaagatgaaaggcttgccaattccatgcaaattttatttatcagcttcctgaagtgtcacatccaactgttgcatcatgaccatttgactcttgagggctggatgttattggaccactgctaaaatcctctggtgggcacttatacatcttggctgcaactgactacttctcgaagtgggctaaagttattgctcttaaggaagtaaagaaggaaaatgttgcaagtttcatccaagtaagcataatctatcgctttggcattcctcgttacataataacggataatggcaagctattcgacaataggttggtgaacaagatttgtgatctctttggcttcaagcaatataactcttctatgtacaatgacgtcgccaatggtctagccgaggaattcaacaagactctatgcaacttgttaaagaaaatcatctctaaatccaaccgagattggcatgaccgtatagaagaagctctgtgggtgtcacacctcctttttcctacccccggaaaggaagtataagagagtttttccaatttaagtgaaaatcgaaataggattatttattcatatttcagagtcgccacttgggataaatttatggtgtcccaagtcaccggttcaaatcccgaatcgaggaaaaaattgactatgtattacagtctgcgaacacagaaattcgggtagggaattctgttaacccgggagaaggtgtcaggcatttccgagttccgtggttctagcacggtcactcaactgttataattggcctattatctgattttaatacatgttttagcatatggttcaattttaactttataacctcttttatttaaatatttttaggaagatccaacgttacataaaacgcgtcttgaaccacgtcacataaatgcacccgcggtccacgacacattttatttaacattgttgagatttggatttgggtcacataaatgcacactcgaatttaggaaaataacttaaattacgcgcctaaagcaactacgcatttttaaatttacgagggtcatggaaatttaactaaatggcacgcctcagattctaaggatttaagatcaattaaatgaggtccatgcattttgagattttatttggcacgacgcacctcaattccaatttttaaagggaattcaaaactaagcttttgaaggccataaactatatcttgcctaatatggcacgccccaaatatatttgcctaaatttattcgaaatgttgagggccataagctagtcgtgttatctactatgactcacctcaactattaacaaagagactaattaattaattaagggaaaaaaactttaaagagattataactactttaatctaaagtctaagcttaatttgcttaatcaaggaaaacgagcacacggaatctgttccgtttttattccaaagcttggcctggcttgaagcccaattgccaatggcccataacttcacaaacatgagcaccattgggctcataatgtcgtccatatcgagaaccaaagtgtagtaaaggggagagggagtttggtgcaaagggattgatattgatagcccaaattgacgctttaaccttaacaaatgatggggacactgcagtttttcataaaatctttgaacctgaaccaattctatgttgaaatatagtctcaggccttatgcaaattaggcatcatgtaacaacaaggttcagaggcctaaattcatgcaaaattccagcttcaaaccatcattcttaacaaaactaacatggccctaaactttataaagaaaaccaactgcaaatagttgaaccaaattcaaaggttctctaatctgatttcaaactcaaattccatttaaaatccttttaaaattcaaagagtctatgcatgaatagaggcaacactaagttataagctttctgaaatcaataaaccaagtttcaagctatacataagtgaatctgaacacatgatggatggaaaaatagacctagctcagattcaactgtcccaaacataaatgattcaaactaacaaggatataacccatagccacactcaaaaccaaacaacctcacaatcaagctaatgaaccaaagtcttcagttaatacacatacctaatatctttagttaatacacatacctaacatctaatatatttctgaattgaatacattcgagacaaaactcatattttatcttaagatgcacgtgtagtattggttacatgattagctacacataagaaaacttggctaggaaaaaagcataaaatacaatgcaacaaacttaaagaaaagaaattggtagagccatgaagaggtaacaaaagtccctttcttcaactggaattacatatcttcacacaatagcctaaaacagacatcatttccattcatggctcgagagaaatacctgggaacaagaggaaacaaggaggagtgaggattcagcaaacaacaacagtagatcagtacccagattcaatgaaacagtaacccagaaaaccaaacagcttcaaactaagcctttaaattcccagaatcaaaccattttttcagccaggtgcagggatttgaaatgcttcaaaactttagctaatagggaggatcagcaaacctagactaagaaggattgagctattttccacagagaaatgtgatgaatctaagtgtcaattcagagttttctcaacaaaaaaattccaaccgtttcagtttagcaggattttttctcttcctttttttttgtttttttgctagtgaagtaaggatgcctttataggtaaggtattagggcagcaatgctgaaaataattttgcactttaaaccttttgaaattttggttttagcttagatacccctagtgtaaagatcagaaattcagttaagtcctaatgacaacttctaggaagcttcctatttcagttatagagagattctctacttacaattcccatatcacccttaaaaccccttgttatttacccttcaattattaacttgagttaagctagaccacagtccaaataaaccagtctcttaactaggtcagtggtgtccatagttactatgagagacttgaatactcagaaatgattaaacaaaaccatagaaaaagaactaatccaaaactggagggcaaactcacacaattctgattttagtcttaaactaactttagctaatctaactaaaatcgaactttactaactaaagataatcagtcacaaacaacgaaaaacaaaagaaacaaataaaactgaaccaaatgaaaacagaaaggaactacaatgtataaaattagtgggagaaaggagggagaaataccaaacatggtggaatgccttgacgacatgaggcatatcaatgagagtgaacaattggctcggaacttgatgaactcgtcaaactctgacatccccggaatgaactaaaatcaatgtcgattgattgttcttgttaagaacaatcaacccgcatagactataattcaaaacgaagccagcccttgaacaaaatcagaagaagagagagattagggttgaattttctcagatttggaactagggaggtcttgttggggttttcgggaaataggcgtgtggataagctttgggatggtctgggctttaactggtatgagtttgggtgggttaaggtttgaaggtccaaacttcgatcaaatattcgacgagttccacgatgattcgaaggcaacaaatgacagattcgttaagaggggaggaagagggtgctacgatgtaaatctggtgtggattgtaggtcaaccgccgccgctggcgatttccggtaggcggcggactgtggtgagaggagggtgtgatgaagaagatgatactatgttaatgttctaaggttttcggatagtcttatgtgattagggtgaggctttgctggccgttcgatgaagagcaatgaaaggcttagattgatttgtctttaagaaactcaaaatgacgtagtattggcctgatactacgtcgtttgaattgtttaggagactgaaaggttggaccgggttggggcatggtttggtctagttttggacgggtttaagggtgcaattgtttgggcttgagagaattaaaataaaatagcccaaaatccgattcttttcttttccctttcaaaattctttttaatccctttttctttttaaaaacaaaaataaaaataaagtaaaacctaatttaattcctaacccaaattatcctaccaaattaaattaattaactctaacaattaccaaaactaattaaagactaaattaaaataagactaacaaaattcaaagctaaaaattaaacaatgcaaaataaattacttttttgtgattttttccatttttgtaaaacaaattaatttactaattaatcaagaaaaaaatgtaaaattaagttctaaatgcaaatgcaatgtattttttttatttttataaaaattaaacatgcactgataaatgcaagcaattaacgaaaaatgctacaaaaaatccgcgaaattgcaaacaatgggaaaatttattttcttgaatctatgagtgtaatttatataggggaaaaatcacgtgctcacagtgagcatataggacaactcactgcacgccaataaaatcgaccccttattcactcatttatggagtcgaagctatcttgccactcgagcgtcaaataacttcattacgattagctattcaagaagggatcaatgatgaagaaaatgctcgacttcgattagcagagttggaggctcttgatgagaagaggttggaagctccacagagtcttgaatgttatcaagctcgattttctcgcgccttcaataaaagagttcgcccgagatcctttcaagtaggagatcaagtcattgccatatgaagatccattattacttcccttaaacctatagggaagttcacttcaaaatgggatgggccatatatagtacaagaagcttattcaagtggggcttacaagctggttgatgcagatggcatgagaatcgaccctatcaatggaacattttttaataagtattatccttgaagttgcaatgctccttgacgcacgagcctaaactgcatgttccaacattcctggcccgcaagagtataaattgtttacgacccaaacaaaaagtctgctaggttgaaaacctcgaaagaggcggcctaggcaaaagttaggacataaaaaaaatcacccattctgaactacggtatgacttaatcctcttcaccgaggtacgtaggtagcttagagtttcattctaagttcaaccgcatacgcttaatagatacatagtgtctcggtcgttatccgaatgaaatacgatagaatgtaatccattcgatcagcacttgaaagtcgagctgatatactattcttcgttaaactttggatcacatttgatttaaagggggtaagccactatggtaaattggtgtcttcaataaaattgtcacgaccccaaaccacctcggccgtgatggagcctatcacattactaggcaagccgattcaacactaatacataaaggtcttttgtaaatttatttccaaatcagttatgaacacaagtctttcatttaatataacaaagtacggggaagaaaacaactacgcaaatacatccacactgcccaattctggtgtcactagtcatgagccactaagatactgtctactcaatacaagaagaaaaaaactgaagtaaataacactaaggataggaaggagaaagataggattgcgaacaccatgcagctaccttgctatctccagaaatactcagaagctgctgaaagctctctagatctgcacacaaagtgtagagagtaacgtgagtacgccaaaatttcaattttgccaatttaagcctaaatctaccatggaccttcaaaatatattctgatcactctactaagtcccaaatcacctaatgaagttatccgaaccataaaaatccaattccgagatcatttacccacaagtcaatttctggttgacttttccaactaaatggtcaacttaagagactaagtgttcatgtccctccaaaactactccaaacccgaaccaactaacacgatacgataaaatgtagttgaacaacacataaagaagcagaaatgggaaaaatgggggtgtaactcatgaaacgactggtcgggtcgttacatcctccctatcttaaaacaatcattcatcctcgaacgagtcaagaaacatacctgaagcctcaaacaggtgaggatatttgctccgcatctcccgctcggtctcccaagtagccttctccacaggccgacctctccgatgcactttcactgaagctatatcctttgatctcaacttttgaacctggcgccccaatatagccactagctctacattataattcaaatcaccatctaaatgaaccgtgctgaaatccaaaacacgagacagattgccaatatacttccggagcatagaaatatggaacaccggatgcacactcgacaagctaggtggcaaagctagctcataagccacctccccgatcctccgaagtacctcaaaaggcccaatgaatgggggactcagtttacccttcttcccaaacctcataacacccttcatggatgaaaccttcagtaaaaccttctccccaaccatgtaagacacatcatgaaccttcctaatagcataactcttctatctcgattgtgctgtacgaagccgctcctgaatcactttcaccttgtccaaggcatcctgcaccaagtctgtacccaaaatcctagcctcgcctggctcaaactaaccaactggagatctacaccgtctcccatataaagcctcatatggagccatctaaatactcaactgatacctgtcgttatatgcaaactctgccagtgatagaaaatggtcccatgaacccccaaaatcaataacacaagcgcacaacatgtcctccaatatctgaataatgcgttcggactgcccatccttctgagggtgaaaagttgtgctcaactccacctgagtacctaactctcgctgcacagctctctaaaactgcaaattaaactgagtacctctgtctgaaatgatagaaactggaatgccatgcaggcgaacaatatctcagatgtaaatctctactaaccgctctgaagaataggtagcacacacaggaatgaagtgcgtggacttggtcagccaatccacaatcacccaaatagcatcgaacttcctcaaagttcgtgggagcccaactacaaagtccatggtgattcgctcccacttccagtctggaatatctaaccgctgaagcaagccacccggtctctgatgctcatattttacctgctgacaattgagacatcgagatgcaattcccaaaatatccttcttcattctcctccaccagtaatggtatctagaatcctgatacatcttcgcggcacccggatggatggaatactgcgagctgtgggcctcctccagaatcaacttctgaagcccatctacattgggcacacatatcgggccttgcatcctcaatactccatcatcaccaatagtcacatctctggcatcatcatgatgaactctatccttgaggataataaaatgaggatcattatactagcgctctctgatgcaatcaaacaaggaagaccaagaaatcacacaagctaagacccgactggattccaaaatatccaacctcacgaaccgattggccaaggcctgaacatcaattgcaagaggtctctccccaataggaatatatgccaaactacccatactcaccaccttcatactcaaagtatcggccactacattggccttccctagatggtacaagatagtgatatcatagtcctttagcagctccaaccatctatgctgcctcaaattgagatccttctgcttgaacaagtgttggaggctacgatgatcagtaaacacctcacaacacaccatgtagataatgcctccaaatcttcaatgcgtgaacaatggcggctaactctagatcatgaacggggtaattcttctcatggggcttcaactgacgagaagcataaacaatcactctacccccatgcatcaacacacacacaatacattctcgaagcatcacaatacattgtatatgaacctgaagatgaaggcaaaactaatattggagttgtggtcaaggcagtcttgagcttctgaaagctcacctcagactcatccgaccacctgaataaagcacccgtttgagtcaatttggtcaagggtgatgtaatagatgaaaatccctgaacgaactgacggtaataacttgccaaaccaagaaagctgcgaatctctgtggctgaggacggtctagggccaactctaaactgtctctatcttcttcggatcaacttgaataccctcgctagacaccacgtgccccaagaaagccactgaactgagccaaaactcacacttggagaactttgcataaagcttctcctctctcaaccgctgcaataccactctcaaatgcttcgcgtgatcctcctgactatgtgagtacaccagaatatcataaatgaatacaatgacaaatgagtcgagataaggtcaaaacacgctattcatcaaatgcatgaatgttgttggggaattggttagcccaaaagacatcacaaggaactcataatgaccatattgggtcttgaaagttgtcttaagaatatccgagtccctgatcttcaactggtgatatcctgaccggagatcaatcttggagaacaccctcgcttcttgaagctggtcaaataaatcatcaatacgaggcaaatgatacttgttcttgattgtaactttgttcaactgcttgtaatcgatgcatatcctcatcttgccatccttcttctttacaaacagaacaggcgcaccctaaggcgacacactaggccgaataaaccctttatcaagtagttcttaaagttggtccttcaactccttcaactccgccgatgccatacgatatggtggaatagaaataggttgagtgcccgacactagatcaataccaaaatcaatatccatgttcaggggcatatccggcaggtctgcagaaaacacatcgggaaagtccctcactactggaacagaatcgatactagacatctctacactaacatccttcacaaacgctaagtatgaaaggcaacctttcccaaccatccgttgggtcttcaaaaacgaaatcaccctactggggacaaaattagttgaacctcgtcactcaatccgtggcacacccagcatagccaacatgacagtccaatatagcccgacacggagatagctaatccatgcctaatatcacatcaaagtccaccatacataacaacaaaaggtctattcgggtcttccaacacccaatagtcaccacacacgatcgatatacgcggtccataataatagtatcgcccatcgaagtagatacacaaatagactaatcaagatactcacggggcatatcccaataacgagcaaaatacgatgacacatatgaaaaggtggaaccaggatcaaataacatagaggcatctctatggcaaacagagaaaatacatgtaattatcgcatctgatgcaatgaatctggtctggctgggagggcatagaaacgggcctgaccaccgcctaatcggcctccccctctagggcgacccctagctaactgtcccctaaccttagatgcttgggcgggtggtaaagtaactggagctgaagtcgagggctgactcctctactaagatggaccctcaaaaagacaaggacactgcctcctcatatgtccaaactatccacactcgtaacaacttgttagtgcagggaacggggactgaagggaacccctagcaccggaatgaccagtagaaggacctggcatggaagagccctgaactgatggagcacgggacgaactctgggctggtagggaactaagtgatgaatggccctgatgagaactatgagaattatggctcgatgataccccacaatgaactgggcgggctcactaagcatgcctgattgagcggcctctatcgtgctgaaactgacctctcgaagtaacaccaccaaaactaccagatccccgaggcctcttagcctccctctcatctcgctcctagcgacgaactaactaaatcttgcgggcaatatcaacaacctcctcaaaagtagcacttgataccttctctatggtcatgagaatctgaagatgatatgtgatgccatcaacgaacctcatgatcctctctctatccgtaggaaccaaccaaacaacatgacgagctaacttcgagaaccttatctcatactacgtcacaggcatatcgccctgacgcaattgctcgaactgcctgcaagctactccctacaagactgtggcacatacttctctaaaaagagagcggagaactactgtcaggtaaggggcattgcaccaataggcatacgcctatcgtaagcctcctaccgagtgaaggcagctccacaaaactaaaaagtagtaaatgctaccccgctggtctccagaatacccgctgtacgaagaatcatctgactcttgtccaagaaaccctaggcatcctcgccctctgcaccattgaaagtcgaaggctgaagtttaccaaacctctccaatcaacgatgctcatcctcaggcataactggtactacaaaatcctgagcaggtgcaaccagctgggctggtggtgcctctggtgtctgcaatccctgaacaacctactcgggtgtgcgggcagtaggagtctgagtgcctttcccggcgtgagaagtggctgttatagtagaaactgcgacctcctgagcaagactagtgcacacggtcaagatttgagccaagatctcctgaagactcggaataacaataggcacaacgggtgcctgagctggccccgttagagcatcccctactggaatctaatcacgaactagggcgccggtggatctgtaggtgttgccttatttgctgtacggtctacattcctacccctgccacggcctcgaccgcgaccttggtctctagtggccccaactggtggttgtccatcctgactagtagcacgtatcctcaccatttgtgagggaatagaataacataagtttagtactagaatcaacagatttgcacgacaggaatttcaagaatgtgaagttttcctaaaggttatgcagcctctcggagataagtatagacgtttccgtaccgatccgcaaaactctaataaatcggctcataacccgtgagacctatataacctaggctctgataccaacttgtcacgaccccaaaccaccccggtcgtgatggcgcctatcacagtaataggcaagccgattcaacactaatacataaaggtcttttgtaaatttatttccaaatcagttatgaacacaagtctttcatttaatataacaaagtacgtggatgaaaacaaatacacaaatacatccacactgcccgattctggtgtcactagtcatgagccactaagatactgtccagtactgtctactcaatataaaaagaagaaaaactgaagtaaataacactaaggataggaaggagaaaggcagggctaaaaatgccatgtagctaccttgctatctctgaaaatactcagaagttgttgaaagctctcattctgatgctctggcacctggatgtgcacataaggtgcagggagtaacgtgagtacgccaaaattccaatttcgccaattcaagcctaaatctagcactgacctccaaaatacattccgatcatgctcctaagtcccaaatcacctaatgaagctataagaaccataaaaccccaattccgagatcatttacccacaagtcaacttccgattgtcttttccaactaaatggtcaacttaagagactaagtgtctcatatccctccaaaactactccaaacccaaaccaaccaatacaatacgataaaatgtagctgaacaacacataaagaagcaaaaatagggaaaataaggttgtaactcatgaaacgaccggccgggtcgttacaaaaatggttatagtcttttaggaggctacaaagtatttgcattgaagtttgggaatttgctatattttcatgttcgtgtaactttgaagcttgttggtcttcatatccacttactgccctaaaaaaggggaagataagagaggtgtcaaaaagggaacataagtataagaagaaagattgattggcacaacgtttcaaattcagtgagacttgtacccaagatatttgtgagaatggagctcctgaatttcgattgatagcaataaaaacgtcttgcaatcccgaatcttccataccaaaacataaaagtttcgatgaagtcgcgccaattcagaattgtcggtatatcaaaatctgatgttgattttgaaatactatctgaaactatccgtaagatattaaatcatacatcttgaacatgttttagattttgaagtcttgttttcaaaaaattaaacagttcataatttcaacgttcctacatcaagatgtaaaagttttggtgaagtcgcgcaatcttcaatttgttggaattttatgttgatttcgaaatattatttgaaactattcttaaggtattaaatcttgtaatttggatatgccttagatcttgaagtctagtttccaaaaaaatcaagtggttcatgattttcacatttctataccaagatacaatttttttggtgaagttgcacaaatctaaaactatcaatgtgtcagaatctaaagttaattccaaaatattatctgggatgactatgaaggttcttgattctgaaattcggatatgccttggatattgaagtctagttttcgaaaatcaagcggttcatgatttcgacgtttctacagcaagatacaattttttttggtgcagctacgcaaatgtgaaaatatcaacgtgctggaatttaaagtcagtttcaatataatatctggtacgattctaagaatgtttgatttcaaattttggatatgtcttagattttgaagtctagttttcaagatatcaaacggtttgtaatttcaatatttctacaccaagatacaatttttttgatgagattgcacaaatctaaattgatagtgtggtgcaatataaagttggtttcaaaatattgcctgggccgattttgaaggtgcttgattgcagatattggatatgtgttagattttaaagcttaattcctatgaaatcaaagggctcatatttttgacgttctcacattgagatatatactttctaccgtaaagctacaaaggtgatgaacaatattatcttcaaaaaaaaataaggatgtatcttcaaatatagagaacctcgaggcatgaatgacaacgatgtttaaaagaaagccaaattcaattacgtagacgccaatgcatcgtgctaagcaagcaactagtgataatgccaaattgtattacgtagacgtcaatgcaccgtgctaagcaagaaactattgatagtgatccccaaaaaaaggtggggggtaacatcaattaaaacgcgcaatataaagtaaaacagatggagttttcatttccaagaatagtcgctagttaaccaaaatcaagagaaaaaaacaaaaaacaagaggcaaataaaatactctatatagtctagtctaaacacaacttaaaattgaccgagtctttaagggtggcctctaagtgttgtttcttcgtccccacgtcggccaagtcatcagcagttgccaaggaaacatgagaacatctacggtactcctcttcaccagataagactctatatccaatctcttcaacctctttcttagctgcatctcggagagctcttaactatttcaccttctccttggcctctttgagagatttactggtgacagatagttactcgtccttctcccctttttcagtcaagacaagatcaagatgttccttggcttttaaaaatggcgttgatttttcaacttccacaaccttgtcagaaagagttgatcgtgcctggtcatatgaagtaacaagcttaaaaaaaacgttaataggtattttaaaggggaaatatccataccctttccatccatctcctcaagaatcacttggatctcgaattgaagaggaagcattgtctgtagtaaggttggagagtttggcatgaattttaggccaggcattcaagatgaaatccttgcgaagagtcaagccaacatttcttccgtcaaagatagacatcgctagtgctaatcgttggtaaaaattaggtctcgactttgctccaagattaggaatgaaagtctcctctaggtccgacttagatattggaagtgatttcctcgagtccgaaaatgctacagattaattactaccctgtggtttactttggtgtgacgctatcaaaatatgatcactacttggttgcatgaaaaaaagatagacggttagtgaagttacctctatattataagacaatatgaaagtttaagcattacctctttaatgaccgtcaaagtccttgaagcactgccaatactgttagtaatctcaactacacccaaattagtgtctcctagtttgtttgaatatggattcactcgcttgaagttttgatcgccatgactactatcactctcattttggaatgggcatttgttgaaggtagggacaacggtgcctaatggaaaggaaccctcattgacttgatgagcttaagaaggtcctttctttttttgagcttctttatatgaaggtcccttgatgtagcatggtgcaaccactttggatttcaaagtaggaggcttgtactcctttttattctctcgaggcatgatctctaaaggcgcagcagtgattgacccatcaaaagtcaccaaagatgctaaatgatcttcaagaaatctcccatgcactcttgtccactaggatttgtactctgacgaaaatagcttttttgccatagatatagctgggggaaaggtcgccctcgcattggtggaattatgtgacccacaaatttgccaaaatctgagtccttcttctagtgagacgttatgaaggttattttccaaaataccaggactagtctgataaaatccaaattgacggctaaatcgatatggactatatggttcaagaatgaaagagttcctatacctcaaagggagataattaaaacggatactcataaagtgatttatttcggttcagatgctttatcattgtcctcaaaatagtaaggtttggacccctccgtcgtggtagaagtccaagatgcattatccacttgataaatgcgttttcttgcatttgtatcatcccaataccttgcagcgccttctccggaatacgccaccaatagtggaacatatgttccttttggaatcccatagtgcgtcttgaagtagtgagcaagccaaccgtatacataatgaataggaaaagtgattttgatatgctcgagctgcgaggacttagagatcttgttcaaaccatagtagatattcgccagaactgggattgcaaggctgaatttccatccatattccatcatgctcaccgttttaaaggtctcgggtcgaataaaatcgccatcttgagagggaaatacgagtgcgcacaaccaacaagataagaatgtcgccagatacgtgccttctctcttttcatgtcaaacctcaagatcagcaaacatcgtctcatccgtgccacaccatgcaactacttctagtatagctcccgcgggattgtgcgttgacttcaaatgggtagattttttctccctccttgctggagcaggtttatatctcaagtctctcgtaccaatattcaatccacttgttaaacaagacctttggatcatgactctccccttcttgaagatggttaaaggcagtaaataggtatccacaagctcgaggagtaaatctttcattcttctcattaacacctgtgagttcgatagcttctggcacaacttcttcgtaaggagaacctccaattggtaaatcgccaatggcgtgtaaatcctaaagagatattgatagttctctgactgatgtaagtaaggtatttgttgtgggaaccaagcttcaagaaacacttgcaagatgtttgagtttcgatcatatgtaaataaagaagcatagacaacatcataaattcttgttctctccaaagcccattgacttctgaaaagtatgtcttcagcccattcccctagaatatgataatattcaccgtcaattctcaaagtatctctccaacgtatctccctttgaatcatacgccatcctaggcaaggaaaggtactcgcgatattgagttttctttggtaagaagtctgaagggaccacattttagttggcttttggttgtgctctgaaggccaatctaccatatggagggaattctgtagaggtggccacaaatttgcatatcgaccaactagtggagggtaagtcttcaattatgagatacttgcacttggaggatagagatgtgtagtctctgaagtgaactatctcttcaaaactgcataaacggaaaaaaagattagtaaatattaagtcaacgacaattgacaaaaggaggagaagatcctagtcctttgtgctttaggcaaatttctataggcgattaagaatattccttctatatgatgtcatgggtttaatcttctatatgttgatatggatttattcgtctatatggtgatgtgaatttgcgcgtctatatggtgatgtgaatttgtctgtctatatggtgatgtgaatttgtctgtctacatagtgatgtggatttgtctgtctgtatggtgttgtgaatttatctatctgtatattgatgtggatttatccgcctatatggtgatgtggattgtccgtctatatggtgatgaatatttgttcgtctatatgttgatatggatttatccgtctatatggcaatgtgaatttgtccgtctatgtgttgcgagggatttatccttttatatgttgtcatgaatttgatcatctatatgtcatcatggatttatccttcttgtttggcctacaaaaaggataaaagagtaaaaataaattaaaaaaaggcacaagaaaatgaagaagaaattacctttaattcttccaaacgccaaaaggcagagcaacttgaaaaccccgtaaggttaatgttcaacaaaggaagggtgtgcgcctatttataaactatggacaacggttaattgaggatgtcgctacgatgtggaataatttttaaaagttgtatcctaaaagaatttgactagcaaagtatccaagtttaaataggaaaaggagatcttctcacattagttaactgaaggagacaagaatttaaatgcaagaagaaaacaatatggtactcacggtcttctattcctaagggatattggaatatgtaatctcaccttttggctacgtgggatttttcctttaatagatatatattatgagagttacaattcataatgctggagtgaagcaaatcaaatacgatatcaaatgaagtattaaagtttggcctgcaagcattattttgtttccctatattacaacatgtaaagatgctgttagaagtaagtttcaagaggtaatataacaaaagtaaactttctccaatacatcaagactagtcttagaaaatgtacgtacctatatctcgacaagtcttgaagtagggggtatttgtaagcatataaattttattaaaattaaatccacaaaataatttggactatattttaattcgagatatattggtccaaacaaatattataggctaatataattgaattaattatataatccaatatatatggattaaataaataagtcttaatcccttgggctagcacatttcattgggctaaagagatgagcccactttattaagccaaagatgtcattttcttagaggcccaatttggtgccacgtgttaaatgacgtggagcgccacgtcaaacagaagagccaatgagatgatgccacgagtcaaaatgacaaggcatgccaagtcaaattaaaaggccaataaaatctcgccatgcgtgcaagtgacatgttctgaccaatcaaatgtggccttgtcatgcttcaatctaattggtcgaaaatagtttgttctcatcacaactttgtcacgaccctaaaactgaaccggtcgtgatggcgcctatcgcgaaactaggccaaccgacacaaacgcaaaaccaaccagaaaatcataagaagtcatttaaaaccattaattaactaaaatcccataatataagtttaaacaagcggtgcggaaatataacacaagcccgacatcggggtgtcaccagtcatgagcaactacaaactcgtctaggaacaagaaaggacaacatagtccaaaaataaaatactatgacaaactgaataagataggagggagaagcacagggatgcgaacaccaagcagctacctagtcaactccggagacctgctggaagactgatcagcactcgctatcacgtcccgacactcctgaatctgcacgtaaggtgcagggagtaatgtgagtacgccaactcagtaagtaataaaagtaaaagcagctgagcagtaagaaaacaagtaatttcacgcagtgttttaaaaggcggaggcatgaggggcgaggcgaaagtcatgagacacggggcgtaagtcccatggatcttcaattttataatttgataatttataaaataatcttaaaaatatttttatatgtgaaaattacattaaaagtatgtacataaaataaaaagcatagggaaattattataattattttataactgaactaacaaacaaaaaataaatactaactaagccacatcctgacaataaggttgtaagtgacgcctaataaaccaaacaatataaggaccaactaaaattatcatggctataatctgaatacctcatgtgcaacagtaacacaaataaatgccaactctgaagatacaaagaccacttaacacttcctttactctgctattaaacattaaataataatttggtgtaaacaaaataatttggttagagatacacaagtatcataattaagagttcaagcggtactctatcttgcaaaaaaaaatacaaatgcacaaaagttatactatatcaattctgttccaatatatcaagcacctccctaaactcctagcaagacttcatcaccagtgtttagtcatagatacagttgctctatcaatcgctatcaaaaacgagggtctcatcaatttccacatcttccagtccttcatcatcctcgactttcactgatttttttgtagatcaaaagagaaggaaaaggtaaaagtgttagtattttgacataacagatgatagcatacaactttataaaaatagtagtagaatactataacttacctgatgatttctgtttttttgttagagggacctgattcacttgtatctcttaaactcccaacatcaatgaatgattcatgtgtaagatcattctcatatggtgtaagcggcactgtgctagcaacatcaatatcaaataaattctcttcatcaagccaagaagaatcttctggaggatcttccttttcagtaatccattcatcgtcagaatcaacttcatctactagaactggatcaaacttttgcaattttctttttatgctcctttctctcagtctagtattgtacctcacataaacgagagcatttaatgtatgatgctcaagtctatttctcttcttgatatgaatctagcaaaaatcagaaaacttacattaagttaagctatcataaacaaactaacaataagaaaatatatgtaaaagtataaacgcttaccgactcaaaggtactccaatttctttcacaacccgaggagctgcaagtgagactcaagacacgaattgcaaatttagtcaactctggagttttcccgccaaagcgtatccaccaatccgtaggagatctcactttcctagaatccacagctatctgacatccaaaatcccctctcaattggtcatatgaatctaactgaacatccactttaaatctctcttcataatccaacattctttccatacattggtacaaactttgtttgacttcaaagttaatacaatctttcctcaaatcgcaattgcggattcaaatagtaccctacaacatgaagtggatgacatagttggcgagtccatctatcatcaattgttttccaaatgggagcatatttgttttcagtatatccacaattcaaggctattttttccttagccctatgtatcatatcatacaaatatcccatgcatggtttttcctctgaatctacttccctcaaaacactcactaaaagggcaacacttttcacacaataagcaatatatggccaaaaattttgatcaaacaaaacgatggctctcgttttcaccccctcgtgtttcttatcccaagcagatttattccaagcttcagaagaaaatataggtctaagagcttgtttttactttttaatgctttgaagtgtgagatatgttgtagcaaaatgagtaatagcaggacaaagaagttcatgattatttataaatgatttcattaaatctaacacccatgtatgtccataaataaatctcacaacttcttttgcttttataagtgtgtcttgatgcattttcaattttcctatatcttctaataacaggtcaatgcaatgcgctgcacatggagtccaataaatatgaggcctagtttccattattctttttccagcattaataaaattagaaccattatcagttattatctgcacaacactcttctctccaacttcatctatggtcttatttaaatgcgacgcaagcatttcaccactttttatagagtccgatgcatcaatagatctcaaaaaaagtacctgtgggactattaattagaaagttgataaaatatctactttttccatccgtccaactatcgaatataattgaacaaccatattactttcaagatttcttatgttcatataacatcttgttaatatttgtaacttcatcttttagtatccaagttcttagctcatgcattgaaagaggtacaaaacccggaccataatttgcaactccttcaaacattgacaaatagtacggatcatttgcaacattaaatggtataccacttgagaaagaaaacctaccaattcgctgacaaacttcttttctttcctctttttttccatttggagtttaaagtagcttgtcttgcttgagcactaacaaaatcatccagcagacctctagcctttggaggcaaattgctcatagttggagaagaacctgattcaccatccatgttaccacttccagttgcaacaactcgcatttcttccgaagtagcctttctcatgatttttacattttgaagctttagtaatgccttcttgcattcttcagctacttcatccggtaccttcggacaaggctctatccctttatgagtgtctgctaaatgtttcttcaatttgttaattgtgccgctaatatgttgagtacagaatttgcatcgaaagtatttctcatccggggtcatgattgaatatttccatgcaacatctgttttccttgcatttttagagccctcttcatcaattgtaacgttttagcttacctacaagaaaagtgagataagaacatttaaattagtagaaaaaatctacatacagcacaacattattgaacttcaaatttcataaaattcctttaccaagggagaacattttttgtttccaaattttgcgtttttttatctcgttatttaaattttgtacaatagataaatctgaatacttttagttctttaaaaattactgattcgagatcaagttggtacagaaagctgaagcaaacatgacaatgcccacaaattatggcaaataacattgaataggcttaagtgtactgttggattaagtatttcaaacattcaaataaagtaaagtttttacagtaaagcaccgttggattaagaattccaaacgagcaaataaagtattgttggattaaaatacaaaaagaatattaaatctcaaccagtaaaatttttttactgtaggaggctaggagcacatacaattggaagaaccacatatgaatttatgaaataccgattatacaattactatagaacaagaaaatcagattcaatgatggataatctctacttaaactatttggaaaggaagtgtagatgggcataaagcagaaagaaacaataaaaataaaaaaagtaataagaaagattaagttatacctttggagttgtggacttaatgtgaaacagagaagttaacaccgtagagtttttatttgcttatggtaagtcttgtgtgggtaaaagtgaaagggttgaaaaaaatattgggaattgtataaattgttcctaatttggctaagttccatagggcataagtcccagaagaaagcgtgcatttcgcctaggcttgcgccccagtatatagtgtgtacgtccaaaagaacttcgcctttttctatcgcccttgtgcgttttcagtgcgccccgtcccgggactcgccctgtactcgccccaataacgcctttgaaaacactgatttcacgtcatagcactacagcaaaacaatatatgtctagaacaatacagtaaatcaataatctcgtaataacaactcagtttagtaaaacctttttaaaatctctttcaatagttttaaacgagtgaagaaaatagtgagtaaaaggacagaaacataaatagcccctcgggcaaaacatgtaccacaaccgcccctcgggcaaaatatcaacaaaattagtccctcgggctacctcacaatcactcgtagtcagcccctcgggcaacaaaatgaaacaacatcagcccctcgggcaatatcacatctctcacactgggtacccacgctcactgggggtgttgagactccggaggggatcctatagcccaagcgctatcacaagccatctcgtggcataacaaatcaggccctcggcctctcatatatcacaaatcagcccgatcccataatatcctcacaacacaggccctcgacctcactcagtcataaacctctcaagccgctcgggcaatagtaaaacatgatgttcagcccaaaatatcatttaaaatatcaaagcagagcaaatacagttgagttatgaaaatagtagaatacaacatgaatgagtacatatattgagtcaaaacagttaggaatagtagtaaaaagcccctaagggtcaaaagcagttggcacgaggcccaaatatggcattcaacccaagacatggtaatactttccaaaacacaatgatatcaaagagtttccaatcaaatacgtgacttaacagtcgtataggacggaccaagtcacaatccccaatggtgcacgaccctacgctcttcatctagcatgtgtgtcatctcaaaatagcacaacgatgtgaaatctagggtttcataccctcaggacaatatttacaatcattacttaccttaatccggtccaaactctagcccctgatgcctttgcctcttgaatcgtcctccaaatctaaccaaaatcagtatcataccattaatacgcactaaagaaacaaagcccaagctaaaataatcaaattaactaaaaaatcccgatattggtcaaactcataatgaccatatcgtgccctccttcttcttcacaaatagaacaggcgcaccccaaggtgacacactaggccgaataaaccccttatcgaggagttcctgaagttgctccttcaactctgctggtgccatacgatacggtagaatagaaatgggctgagtgtccggcaccagatcaataccaaaatcaatatccttgtccggtggcatgcccgacagttctgcaggaaacacatccggaaagtccctcactactaagaccgaatcaatggtaggagcctctgcattgacatcccttacaaaagctaagtatgaaaaataaactttcccaaccatccgttgggccttcaaaaatgagatcaccctactgggaacaaaatcaagtcgaacctcgccactcaatccgtggcacacccagcatagccaacgttactgtcttagcatgacagtccagaatagcacgcagagatagccaatccatgcctaatatcacatcaaagtccaccatacaaagcaatagaaggtttactcgggtctccaaacccccaatagtcaccatacacgaccgatttacgtggtccataataataatatcacccaccggagtagatacacaaagagataaaagaagagacttatggggcgtattcaaataacgagcaaaatattatgacacatatgaaaaagtggaaccgggatcaaataacacagaggcatctctatggcaaacagagacaatacatgtaatcataacatctgaagcaatagcatcgggtctagctgggagtgcatagaaacgggcatgaccaccacctgattgacctccccctctggggcgacccttagctaactgtcctccacccctagcttgctaagtgggtggtgaagtaactggtgctgaagtcgatggctgactctctgctgagatgaacccccaagacgacgaggacattgcctccatatgtgacccaactctccatactcataataaccccccggtgttggagacggggactaaagggaacccctagcaccggaatgactagcagaagaacctagcatagaagagccctgaactgatggagcaggggacggactctgggatggaagggccctgagtgatgaatggccctgatgagaattgtgagaactatggctcgatgatgccccacgataacctaggggagctgactgagcatgcctgaatgggcggcctatgccgtgctgaaactgaccctcatgaggagtaccactgaatccaccctaaccacgaggcctcttagcctccctctcaatcctctcctgaccacgaaccatctcaatctgtcgagctatgttaacaacctaatcaaagttagtatcagacactctctctctagtcataagcaaccaaagttgaaaatcgaggccatctataaacctcatgatcctctctcgatctgtggaaaccaaccagaccgcatgatgagctaacttagagaactacatctcatactgtgtaatagatctgtcgctttgatgaagctactcgaactaccagtgcagctcctctcgacgagactcaggtataaacttctccaaaaagagaacggagaactgctgctaagaaaggggcgctgttccaactggcctatacctctcgtaagcctcccatcaactaagtgcagccccgtagaactggaaagtagtaaatgagaccccacttgtctccagaatacttgcggtccgaagcatcctctgacacttatccaagaaaccctaggtatactcgccctctgcatcactgaaagtcggaggctgaagtctaccaaacctctccaacctgcgttgctcgtcttctggcataacaggagctacataatcctgagcagctgcaaccggctgggctggaggtgccctcggtgtctaaagtccctgcacgacctgctcatgtgtgcgagcggtaggagtctgagtgcctcccccgacctgagaagtaggtgcggctgtagtaactgagaccgcctaatctaggccagtacacactgatataatctaggctagggcctcgtgaaggcctggaatcaaaatgggcacagctggtgcagctggagcgtccacaactgggacctgatcatgaactggggcggctggtggatttgcaggtgccgccctagctgttgtgcgggctacacccttgcccctactatggcctcgaccgcatcctcgacctctagtggcctcagctggtggtactggtggtcgtccgtcctggccggtagcacgtgtcctcaccatctatgagagaatagaataatagaagtctagtactagaatcaacagattcgcacgataggaattcaagaatatgaagtttttcctaaaggttctgcatcctcccgaggataagtacagacgtctccgtaccgatccgcgagactctactaaacctgctcatgattcgtgagacctatgtaacctaggctctaataccaacttatcacgaccctaaaactgactcggtcgtaatggcgcctatcgtgaaactaggccagccgacacaaacccaaaaccaactagaaaatcataagaagtcatttaacaccattaattaactaaaatcccataatataagtttaaacaagcagtgcggaaatataacacaagcccgacatcgggggtgtcactagtcatgagcaactacaaactcgtctaggaacaagaaaggaaaacatagtctgaaaataaaatattaagacaaactgaataagataggagggagaaacacaaggctgcgaacgccaagcaactacctagccaactccggagacctgctagaaaactgatcagcactcactgtcgcgtcctgagactcctggatctgcacgcaaggtgcaggaagtaatgtgagtacgccaacttagtaagtaataaaagtaaaagcagttgagcagtaagagaacaggtaatttcacatcataacactacaacaaaatagtatatgtccagaacaatacagtaaatgaataaactcataaaaacaacccagttcagtaaaacctttttaaaacatctttcaatagtttcaaacgaatgatgaaaatagtgagtaaaatgatagaaacgtaaacagcccatcgggtaaaacatgtacaacaaccgcccctcgagcaaaatatcaacagaaccagcccctcgggctacctcacaatcactcgtaatcagcccatacgacaacaacatgaaacaacatcagcccatcaggcaatatcacatctctcacactaggtacccatgctcactgggggtgttcagacaacggaggggcacctacagcccaagcgctatcacaagccatctcgtggcataacaaatcaggccctcggcctctcatatatcacaaatcagtacaacatgctatggcgcgcagcccaatcccataatatcctcacaacacaagccttcggtctcacttagtcagaaacctctcaagccgctcgggcaatagtaaaacatgatgctcagcccctaatatcatttaaaatatcaaagcggagtaaatacaactgagttataaaaacaatagaatacaacatgaatgagtaaatatattgagtcaaaacagtgagaaatagtagtaaaaatcccctaaaggtccaaagtagttagcacgaggcccaaatatggcattcagcccaaaacatagtaatactttccaaaacacaatgatatcaaatagtttttaatcaaatacgtgacttaacaattgtacaggacggaccaagtcacaatctccaaaggtgcacgaccccacgctcgtcatctagcgtgtgtgtcacctcaaagtagcacaacgatatgaaatccaggatttcatagcctcatgacaacatttacaatcattacttacctcaatccggtccaaactctaactcgcgatgcttttgcctcttgaatcggcctccaaatcgaatcaaaatcagtatcataccattaatacgcactaaaggaacaaagcccaagaaaaaataatcaaattaactcaaaaatcttgaaattggccaaacccgacccctgggcccacgtctcaaaatccgataaaaatcacatcaatagaatccttatccacccacgagtctatacataccaagaacatcaaaatcggacctcaaatggcccctcaaattcccaatcaaagctctccaattacaagccctaattccccaattttaggctttaaatcccacaaatttcacgtttaattagttagaaattaccacagaatcgagtattgagttcaaaaaccttacctccaagtgtttccttttgattccctcttcaatccctctcaaaaagcttccaagccgttcaaaaattgtgataaatgggctaaaaatcgtgaagatgagtttttatacattctgcccaggtgctcccttcatcgcgatcgtggaaactgctttgcgatcgcgaagcacaaaaatttactgccctcatttaaccttatggtatcgtgtaaacctccatgcgatcactgagtactgcctttgctaactcacatgatcgcggcctctcccacgcgatcacatagaacaacatctccactcctcaccaactccttctctcctacgcgaacgcgaccctagccacgcgttcgcgaatcacaacttcacagctaatcgcgctcgcatcctgactctgcgatcgcgcagaacaaatatcacctctgcccacccaagcctatgcgatcacgaacatttctacgagatcgcgaagaacaaatcgtctgcaacagaataccaacagaactgctaactcctcaagtccaaaatgtcccgttgagcacccgaaacacacgcgaggctcttgggacctcaatcaaacatgccaacacatcccataacatcattcaaacttgttccaaccttcggaacgctcgaaacaacatcaaaacatcaaatcaccctcggattcaagcctaagaattctagaacttctgaattccgcaaacgatcaaaaagtctatcaaaccacacccgaatgacctgaaatttttcacacaagtcaaaaatgacacagcagacctacttcaattttcgaaattccattccgaccctgatatcaaaatttccactaccgaccggaaaatgccaaatttctaattttgccaattcaagcctaaatctaccacggacctccaaaatacattctgatcacgctcctaagttccaaatcacctaacgaagctatctgaaccatcagaattcacatctgagacctttttcatataagtcaaaatccgattgactttttcaacttaagcttactcaaaagagactaagtgtctcgttcctctccaaaaccactctgaacccgaagcaaccaaatcgataccacacaatacaactgaacaacacataaagaatcaaaagtgggagaaacgaagtggtaactcatgaaacaaccggtcgggtcattacaaactcttccctcctacaactataaatattggtttttataactcagaaaaatgaccagaagttataacaagaagacacgagggagctcgtggaacaaaggacacaattctctcaaactacaagtgttcaagcattcaagcacttcaacacaaatttcaagtattcaagatcaagaatgaagtcaaatcaaatacaaggcgttcaagatcaaggctacttgttcgtgataaaattcgtggtaacaatcaaagtgttcacggaggataaatcaaattcaaattcaagatcaagctcaaaggcctttgaatttatattgggaaagaagaatcagaggaatcatagagattataacactcaaactatttgaaataaaatactatgattgttgcaatatttttcggtctcgattattttcttaacgcaattttattatctacaatattatttgcctacataaaaaatttcatacaaggtcttacaaggagcatagcagaagacggcaaccctgaattcttgctctgtggaggacctgtgcaacgtttttgagaggttagtgttctaatctctgtaattatatcactgtctagtttacatgtttgtgatatttggattatatgcttgcttccgttgcgcatgttctaacaattagtattagacatcgtcttacatctaactagataatataatacaacatgaattgagtaacattaaaaagtgttgttaaattatacatgtttgatatagttattctatgaaaacaatgatgttttttatgaaaacgtgactgttttgagtactattttagttctgaaattatgtattaacatacataagtatgaacaaatgtgttctgtttcatgaaaacaatgatatttttccatgttttattgcaatttttccatgataatagtaatttttaatataaaaatgagactgttataataatagttctgaaatcatgcattaacatatatacgtatgatatgtgatatgaacgaggcaaaataaatagaaccctaacaatgccaaaaatagattttgcaaataggtcatgaatttggaattttgaaattctgtcgaacttcgattaacctcaaatttggtaggttcatcataaatgacctagatgggtttcagggggttttagatgggtttttggccaattttctatttttggaaatatttttttaataattttttttaagaaaactgtggtggtagggttcactccctatggttttcattcatgttatacagtaatataataaatttatatgatgacatagttattcttccacatcggataaattcattatagataatcactgtagttttgcccctagttgtttgataacttgtattaactctccaattgagttacatgttgattcaatgagactagggtttataaaaatgatattacctatattaaattgatagtttgctctccatttgagtaggtcctggtttaatttatggggtaaatatcttacataattcatatattttgcatgaataattaagtttccctaacaaatctaactattcaatgagcatggttatatgtgtaatgtactattttgaattttattatcctaattgaataactaataatctatttaatgtgaatatctctcagattaatcatatcttcattcaatccacttacctcaattttgaaccaaaacaagttaagaaggaccgaattatgttgactgaaaaaggaactttgatattgtcctaactgttgaaggttacaaattcataattaccgaggagtgcccaaaaaacatgatgaagtgctaccgatgatcaggttaaggcctatgataaatgggttaatgctgatgagatgacacgatgttatattcttgctcctatggaaaatgttttgcaacatcagtatcagtctatggggtctgcttatgacatgctcaaaagtctcaaagagatgtccggtgagcaaaatcatacggctaagcagacatccatgaaagcccttttgaatatcatcggttagagaccatgttacgaagatgatgggtcgaactagaggtccttggagctatgattgataaggaatctcaagttgagatggtagtgcagactctgcctgaaagttttcaacaattttgcttgaactttaatatgaataaaatggatttgtcactagtgaaattattgaatgagcaaacgacagaatctattatcaaacagtaatctctggttgtggcactaaatattgagaaagcttcggtttctaggccgagaggtggtaagaaaaaggggaaggctcacaaggttttggcacttggaggtacgactgctggtgtgaaaaatcccaaaggaaagtgttataattgcaaacaatattgacattacaaaaagcaatgccctgcttatctagcaaagttgaataatcaaggtaattcaaatttaaatgtcattaaaacttgtttagcggttgtctctatcaaattttggtgtgtagattcaggagccactaatcatatctgaactactttgcatgggcttcaggaaacacggtggctaagtgagaatggagtttgcgtttttcaagccaatgatgagccaacaccaactttagcattaggagatattagattttcatttagtagtgatagagttttagttttaaaggatgttctctatgtatcttctatcaaaaggaatttgatttcggtttcaaaaataatggatgctagttataatatttattttgataataattgtgtagttattaagtttgataaatgttttatctacactgctgctagagtgcatgacctttttattcttgatatatctcctcgtgtactacaaccaaaagaattaaataacattaatccatcacataaaagaaaacgtatttctgaattgagccaaacttatttgtggcacttacgtctaggtcatataaatcaaaataggatttcaaggttgctttcagatggacctttgagttcgttgaaattggaggcactaccaacatacgaatcatgtttagaaggtaaaaagatcaagagatattttccctcaaaaggaaatagagctagtgataagttagaattaattcactctaacttgtgtggtcctatgaatatacaagcaagtcgtgcttttgagtattttgtgactttcatagataattactcaaaatatggatacatttatctgttgtgccgtaagtctgaatgctttgagaaattcaaagaatttaagacaaaaacggagaaacgatataaaaaaatatcaaatcattgagatctgatcatggtggtaaatacctttctatggaattcactaaatacttatcaaattgtggaattacatctcacttatctgcccctgaaataccacaacaaaatggtgtggcggaaagaagcaataggactcttatggaaaatgctagatcaatgttaagttattctgagttgccttcttctttttagggatatgctttagaaacaaaaaattatattctaaatttggttccttcaaagttagtaccttcaaccctagcaaaattgtggactgggcgcaagcccagtttacggcacatttgagtttggggttgcccagcacatgtgctgaaaaagaaagcgaataaatcggaaccgtggacagaagtgtgcatttttattggatatccaaagggaacgaaaggaggtttattttattgtcctaaggaaaagaaggtaattattacgaaaaatgccagagttttagaaaatgactatttaatgaaccatattcctagaagtaaactagtttttacaggaattaagcaatgggataactaatgactcatctatgaaacgtatcctggaagccaatattggcataccactgcattattatagtgggagaaatgtcaataggcagtagaatgcacaagagcaattgtctgacatctcactaccccaaagtagtgggagtaatgttgagcaacctcagattgttgagcaacctgcacttcaggaagaagttaatgatatcccagcaccgcaaagtatggaggataacattgaggcttcagttttaggaaatgatgtaacagttcaacatcaaaataaaaatgcacctatagtgacttgtcggggtgggagaattattaaaaaatatctccgatttgcgctcttgggagaatcatatgatataatccccaaagagcctaatacagaacctcttaattacgatgaagcactgcaggatacagacgctgataaatgagttgttgctatgaaatctgaaatggagtccatgtactccaaccaagactgggaccttgtagaaccacctactggagtcaaacccattggttgtagatggatctataagaaaagagaggaatggatgtaaaagtgcaaacttttaaagctagtcttgttgcaaaaaggtttactcaaaaagaagggatcgattatgaggaaacgttttcaccagtagccatgcttaaatccattaggattctcttatccattgctgctcattatgattatgagatttggcaaatagatgtcaaggcgcctttccttaatgaaagtcttgatgagtgtatctatatggtacaaccaattggtttcataaaaagtggcaatgagcacatgttgtgtaatttaaagaaattcatttatggattgaaataggcttctagagcatggaatacttattttgacacttcgattaaaactttcaattttgatcaatgtgaaaacgagtcttgtgtctataagaagtgggatggagataaagttacatttttggttttgtacgtagatgatatcttgctcgtaggaaataatgtaagcatgttagattcagtaaaagagtggttgtcctcgcgctttgatatgaaagacttggggcaagcggcacatatccttgggatcaaacttatgcgagatcacaagggaaaggatgttagtcttatcccaagcactttatattgatactattctcaccaagtttagcatacaagattccaagaaaggttttcttccttttaggtatggaatctctctgtcaaaagaacaatccccaaaaacaattgatgagataaaaatgatgaaaacggtcccttatgcttcagctgtagggagtctcatgtatgctatgctatgtactagatctgatatatgctttgttgttggtatggttagtagatttcagtctaatcctggacgagaacactggactgctattaaacatataatcaagtacctgaaaaagactagggattatatgttggtttatcactcaggtgatcttgtactcattggctatactgattcagatttccagttagatagtgattctagaaaatctacctcaggatatgtttttaccttaggaggtggagccataagttggaggagtatcaagcaatcatgtgttgttgattccaccatagaagccgaatatgtggctgcctcttaggcaactaaagaggttgtttggcttgggaactttctaaaagaccttaatatagttccttcagttcaagcaccaattgtactttattatgacattagtggtgcagttgcaaactcgaaggaaccaagaagccataaaaggaataagcatattgagcgtaaatatcatttaattttggatataacttagagaggtgatgcaaaagtgttgaagattgcgtcagagaacaatttggcaggctcgtttacaaagagcttgccacagaagatttttgacaaacatgtagaagggataggtattagagttgtagacgcatggttatgagtttaagtgggagattgttgggatatattattaaccatgcggtttagttatagtattatgttttattctttatggaacaattgtttatttgatttatttaattcaataaagtattattttaaataaaccatttgttacatgtgtgtcctttagttatgtagtagacaatttagtgaatgaagtcttagctcatgcacataaggttaaattatcggttctcatagttaataaattatgttcacaatcgaagatattgttgggtaaaatatcttgatgattgtagtacaagattaaagtataatttatcttggttgtgggagtgatttttctccaacttcttgtactagtatacttagtgtttattgaacggaccaagtagagaaaagatattttgtaccgaatatatatatatatatatatatatatatatatatataacatcttctctcattcattaaatgagcttatactcctaatcttgatataattattatgatcaatgtggtttgtttattattttgatttatcaaaaggtacaactctattcaaagttagtgtatggctaatagattggacaataacaaatagaatttgtataataataacaaggtgatagaatcctgtcacacctcctttttacccgcgccgcaagggcgcagagggagtttttccaattaaaggacaatcgaaatgggatttgtttatttatttcagagtcgccacttgggagatttagggtgtcccaagtcaccaatttaatcccgaatcgaggaaaagaatgactctgtattacagtccgcgaaccagaaatccggataaggaattctgttaacccgggagaaggtgttaggcattcccgagttccgtggttctaacacggtcgctcaactgtcatattcggcttgtttatctgattttatacaattatgagctcatgtgcaagttttaactctttaccgcttttattattatattttaaaaaagaatgtgaacatcgtttaaaaaacatgtctttgaattgcgtcacatgaaatgcacccgcaatccggaacacatttttattcagtgttttgggatttggatttgggtcgcatgaaatgcacacccgagcttaagaaggtaagattattaaaatgcgcgcctaaagcgattacgtattattattttgggtaaggccgtggagttcgctaagcggccgatcccgagttctaagtaattaatacatacatttgtgacggccccgcaatctatacgttttactaggctcatctcatctcattttttttatgcacaatcctaaaatgactacatttttctattaaaattagtttctaaaatagagaaagaaaatcctaattaattaggagctttcaaaaaaatttaaaaaacgtaacatactaattgctagattaagacaaatattaatggaaaggaactttactaaaaataaagaaaaaagtgaattcgaaatcataaataaaataagaaatttgacaactaatattcaaaagaaatcaaatatagctagattgaagctcgcattgttatataaaaaaaactattggaattaattattcataaccatttgaaactagatttaaccataattactaaagcttattagaaaatttattaaacttaaacattatatagtcttgtttggccttaactaaatttagctactcattcatgattaacctactgttgaccatattaaaaccttcatagctaatgaattaacccgttttgccaagctgattcactaaagaccaacttatgtcattttcctcttattccaattattaaacagtaatacatgaaatagcctaaatacaatcagtaaaagaaacgaagaaaaagcggaattaaaacttcaaagttccattcttcatatgtattcatgctttcacattttccgcttacgatatcgacaaggttacagccatgtacctggtattgaatacaagagaagaggaagatgagaatcaacagcagtattaacaattcagcacagcaacaacagtccagcaacacaggaatagaccagtaatagagtttgcaaaccggtggagtagtaacccaagaaagaagcttcaagcttcgatgaaacaatagcaattaatgctaatttcaaacaatgaaggaaagtagaagattttttttcagtttgttctctcccccctttgttcttcttcctttttcttcaagtatcaaatgagtcctcttatacccaaagcaagactaccttttcttttttacctcttttctttttccccaatattcttctactatgtataacttttaactttttattattacctatattatttctgatttttaacttaagtaaaagtagtcaacacggaccccacggtttccctctttttgaatggtcaaagaagaactcatcattatccccttttctttttactttacatcattatgtcttgtcccccactaacatatgtcttgtcccccactatattaaacaattatatcaacccaccactacctcatgtcttgtcccccaccaggtactattttaattttgttaatgcctagtggacagagcactcagattaaataattgttcaaattataattccaaaatacccctccgaccttactgaaattaccattttacccctaaaagtactgcaatttaccaatctacccacatcagctatacccaatttacttaatcaattccaaccaaaatacagcaaatataaccaattcctaaacaaattcaatcaacaaatcccatgaacacagattgaatcatacaacatcagattaatgggaataagttaaccatattgggaaccaatcctggttaacttagacaaaaaatgaatgagcaaagggacaacaatattaacaacaaaagtaaactgaaacaacatgaatcacaattaactgaatcgaaatgcaaactgaaatcatatgatgaacaacaaagagcaggaaaccaaacaatacacaaaacgaaattattcgaaccaactcaatattaacaaagatactatacattctacaactaataatcatgaatgacaaaccaatcgaactcaaattcgactaaacagatttcaaagaaattttttacaaccaagattcaactaagaacgattcaaactccttcaaccataatatttaaacagattttagcggctcttatcttactcacatatagatcataaaatgagaaagggagattagacggaccttaaaaacctttaacaatccggacctctactgcgtatgaactgtttcaacgaccccgaccaaagctcgaacaaatgagatggtggggtctcgttttggattgaaggcgacaaaaaaaggtgaagcagtagcgatgggaattggttttgaatcagatgctcgatgaggaagcagcaacacaacagaagcagatgctggacggagctaagccagcagcaacgcagtaggtgcaacttggttttgaagcagatgctcgacgaggcagtcatgggaggtgagacatttgggtctgctggaggtcgacgagttgttcgtcatcgacggctggatgtagcaggagcagtagtggcgatggagcaatggtagcggggttgggtggtgctacatggtacaagggtgagagacggtgaatgtgacatatagcttcctcctgcttttgttccgaggctgctaggttttggttttaagttgtctaggtttgttttgtgaagaagatgaggagctggtgggtcaactggttaatgtcgcgaaagtttaggggtgttcttttaggttgagatgaaagagcagcagtggctgtttagcttaggagatggacgatggtggtttgtgtgttcgagctggaggtcgtgaggatgatgaagaagatgaagcagaggggtcgttcatggtggtcgacgaagaagatgaagcagaaggcgaggtgctagggtgttgtttgtcgagggaggcagccatgggagctcgagctcgagctcgatgacgaagaaaaaaacagcctgcttggcttttggattggagctgtgtgtgtatgtgcttgtgtcgaagaagacgatgcaagggcagccatggatgggggcgtgaggaaacttggagaagatggagagaaagagagagggggggcggatgggtttaggtttagcgtttttttgtgaaaaaaaatgaaaatgaagtgaagataggaggttgggtcacttggggttatggggcgtaccgggtcgggtcgactcggtgggtctttgggttggataaggggttatttagtttgggtagaggtgttttgggcctaggttcaaaattgaggaagaggcccaatttcgatttttctttattttttgctctcttttcttttactttctaattaataaaactaaaattctaaattaagttataaactaaattaacttatcaaaaatattaactaatttctagcaacatttatcacacataattaaacactcattaaaacaaaattgcacaatttgacatttaatgctaaaaatgcaaacgacgcatatttttgtaatttccattcttgtaaaacaaacttaattactcctaattgtagaattaaatcctaaatgcaaatgcgacatatttttgtatttttattaattttaacaaaaaaacatgcatggataaaatacaaataattaccctaaaatgccgcgaaaattctcaaaattgcacacaaaggaaaatcgttttattttgaatttttgggagtaattctttcatagggcaaaaatcacgtatttacagctgcccctctttgtccgaagacacgaagagttttcgtgcaatgataaaatgagcgttttttgcccatccgagtactccgtgtgaagcatttttttgaaaaatatttaaccgaacctttgcttcaaaggtttcctacatatccctggctataagggaatcaggttaatgtagttcgagaagttttggtagctgggactaccatgggactgcaatgttactgttgttgcatactgttattactgcttgccgaccaccttattacaccatgctgaaagaaaacaagaagctagactaaactatagtctatgaattacaaaatcttatctagatcttcaatcatgctcttgtgtctcttgttgatttgatgtcttggcgactcccctggcatttctttacttctggtttgtcttgtgttctccctttgtagacatgtgatttttgaccctccccaagatcttttatatattagcgtaaaatatttaatttaggcattatatagatattttaagtaattttgactcttttactttattttaatacaagaaaacaaaaattacaaaaaataagttcattaatattttgtagtcatttttaatctaaaaaagaatatataaaaatagtatcgtatttttatttttaatataatgtttgataatacaaaaaatagatttgttttaatggttagttttgttttaataattattttaatagtagaactaattaataaatgagcgcgtatttttaatctcattcgcggcaaaagaatagagcttgggctcgagcaacccatctttaggcctaattttggacctagaccacaattgccaagcctataattcctaggcccataccccttaacctaaaaccctaccactaacctagacctatatatattaaacaaagcctaaaactaagggggagctgaaggaaaagcagcaaagctgcgcatgaagaaaaaagcttcttcatttaagaagctattacgagcagcagctagaacgagttgcgcaacacaaacgacctcccccccgaccatcatcttcttcacgacccaccatccctgcatcgtcttcttcacgacccaccacccttgcgtcgtcttcttcgagcacatggcccccaccccctccacgtctccgtcttctccaaacgcaccccactgtcgttctcttcttcttcagtaacaaccagcatctagcagctccatcgacgaccaccgttcagctcaccatcgtcgccggacctcttcacgtccaccaacgaccatcctcacgcaagcctgaaccaaacagccatcactacctttttccttcagctataacacacccaaactaccccagccaacaactactctcatgcctccaaactccatggaagcagctgaatagagctccaaaatgagctgacaactcccagtaaactcgcctgtaaaccactccgaaggagcctcgaaaaacagtccaaaatccggccaggaatcagaaataaaggagcgtctcgtttcttgcccagattcgccgaaaaatgcgcctagttcatctcattattgtttcgttcaaaatccggcagagtccgtttggttttccatctgagttcctgtttttccgttaaggtcggcgatttgtcgaggtattgtcgttggttttcggcttgagttctgtccagaggtcgtcggattcatctcttttatttcccatgtaaggttagtttctattttattgtgtcattgataataatactacattggttggtcaatatttgtcgccggagaaactccgtcgctaaggtttaaattttgttctttgggtgtcttcttggagcttttatatgaggtttcatatcatatgctttggttttgttgttgtaaatatgtggttttcaatgttagcggctaggaaggacaataatatgacgtgtttgatttgtttaaagatgtgttaattctgtttgaagttgaataagcttttcataggagatgacagtccatttgagggctaccttgggaatttattgtacttttactcttttatggtttctagtcttctttggattgtaacagtgtggtgctactagttttttttctttttctttttttggtataaataacgtactattttaaaaatgtatttggataggtttaaaagtttcatcttaaaaaagatagtaaatatagctttgggtttgggcagggtcatatttggtattgtttattactttgatcgttacttttgggtttgctcttaatacatctatcgtgattgtgtacacgctcgcgtgacataattacgattctaaatcaattcggaatatgcgtttcgcaacttcgagcaagctttcttaaattgttttaataggccgaagtgcgccatgtcgaataaaattccaaaattcatggccctcatttatttatttacttcaaatccttagaaatcgaggtgtgccatttagttgaaattccatggccctcgcaaagtgcaaacgcatagttgctttaaacgtgctcttaatagaattaccttcctaaactcgggtgcgcattgatgcgacccaaatccaaatctcgatgaagtcaaaatgtgttcacaatcacgggcgcattgattgcgacggggttcgtaacgcgttttcacgacatcgtaattcttataaaataaataatgatataaaagaggttcacaaattgagacgagcctcaccacacaaaaatgaataaatgtggggccctcaataagtggttattaaaaatgattagaatttgggatggccatttagcgaacttcacggtcttgcccaaaataatattacgttagaatctttaggtgcgattttaattaaattaccttcttaaactcgggtgcgcatcgatgcgacccaaatccaaatctcgacgaagtcgaaatgtgttgacaaccacgggtgaattgattgcgacgtggttcgaaacgagttttcacgacgttgtaatttttttttaaaataattataataaaagcggttcaaaattaaataaaaggcacataagctagcatgtattaaaattaaataaaatcaaatacaacagttaagcgaccgtgctagaactacggaacccgaaaatacctaacaccttctcccgggttaacagaattccttacccggatttctggttcgcggactgttaacagagtcatatttttcctcggttcgggattcaaccggtgacttgggacaccattaatctcccaagtggcgactctgaataattaattattaaatcccgttctgattgtcctttaaatggaaaaactcctttacgcccttgcgaatgtagtgaaaaaaggaggtgtgacagctctggcgactttgttggggactttaacccagaacatgttgttcagggttcagaattcgagcttatataaattgttgtatttgattgtatctgattttcctacatatttttatgctgaatatgctaaatgttaccgctttgatattatctgaactgtatataaattgtgccgacacccttctctcttcacctccggggatgtgcttactggttgagactccctattcggttagtgtcataccttgaaataagaaagaggccggacaagttacgaagccggatggccttttggttcccggtaagttgccccctcctcgactcgagttgttcgctcgggtacacagtctagaacactgacccaggttttgaacatagaataacgtgacttcatgccggatccctagtaggaacgcttatttgcatcacgttgcattcgacttaggggactcaacacaggggttgggtccgtctaggactagcaacctgaaatgaaaagaccatcctgatgcattctcttgtgctgtgcatttatttgttccggacctgcatgttgaccggttttcgcatctcagaaatgttggaaaatcgaggaaaaaggaaaaaaaagggaaaaggagaaataacagttagagaattaattgattatcctagaaaacccaatgcccaaacactatcgaaactctgccgaaatttttgaaaaaaggaaaatgcattatttctaaaagtctgttttactaaaagcaaaagaaaataggaaaaagagtcttttattttttgaaagtgtttgttgaaaaaggaaaggaaaaagagtcttttatttttagttttggaaaaataggttgtcttattgtctgtggaaaatgaaaaaaaaagagtctattatttttttagcttgggaaaataggttgttttatttgttgaaaagaaaaaagaaaaaagagagtcttgtttctaaaaatagtttttattcgcttatgaaatgccaaaaataaaaatggaaaagagtcatgttttaaaatagttcggttaatttgcccgaactatgcatggtttgattctcacagggcttgagatacgtaggcaaccctcatcgggtccaacctcccatttgcaaaaataacccaaaaatatcaaaattttaattttgtcataaataaaccaggtgatgccgtttttgtcaaaaatagccaaatattcccaaacggggtgccggaaggctgactttgcataaatagccatctttggtcgtatttttatttttgaccctcacagccttaaaatcttcgcccccgaggcgcaggaaggccatgtttgcaataccgggtcatttattttaatttggaaaaaacaagaaaaaaagtcagtggtcaaatgaataccgttcagattttgggtcaaaattggcatataggggaaggactgtcattttggggtttgtatttcttttgataagagtatatgggtcgtttgattttcgagtctgtatttcatcattaagttggttagttttgttgttattatgaaaagggaaaattccaaaaaatgttttattgtcgtttaccttttatttgcaagaactacgcacggtctgattcatgcggggtcatgatacgtaggcaatccccataagattcgaccacaaccaaaaaaaatgaaaaatggaaaagaagaattgaataaaaaaaatggaaaagatgttgttaataatgaggaccgactcgatacattctaacatgttttgttttgaattgtgaagaaaggtgaggtggttggtttgtggtaagctggaaacacaagatctgaggaaaaatgataattgacatcgaaactgttacgagtgctcaagagactcagggtcagagggttcaacaagagtctacggtggttgaggaaaatagaacactgaaacaacaaatgaccaaaatgcgccaagcctaggccaatggccaaggacagccttgtcacgagtcataatttgctacacaacaagaacagtaccactatcccgagtaccactcgtactcggttgatcttcctgcaaatatcgagaagtctgcccgaaagagggtacaggaagaaataacccaaagagtgaaaagattagaacaacggttgaaaaacacgcaagtaatggcaggacaaaagagtgttgccttcagagatctatgcatgttacccgatgtccacttgccgcctggcttcaagatccccaaatttgaaaagtacaatggacatggagaccccatagcccacctgaaaaggtattgcacccaattgagaggtgtgggaagaaatgaagaattatttatagcttattttggggaaagcctcacgggtgtagcatctgaatggtttttggatcaagacacatcttgctggtacgtctaggatgacatggcacgggcctttgtcaaacaatttcaatacaacatcgacatcgccccagaccgcatttccctgtctaacctaaaaaagaaaccaactgaaactttcagggaatatgccatcaaatggagagagcaggcagctagagctaagccacccatggatgaccacgagttaatcactgtctttctacaggctcaagagccaaattattttcaatacatgacatctgcagtgggtaaatccttcccggaagtaatcaaaatgggagaaatggtggagaacggttttaagacaggcagaattataagttaaacagctctcaaagctgcagctcaagctgtccaaattgaatttggtaacacgaatgagagggatgaagaaatcatggtgatatcagggtcgagaagaggtcctaggagaacatctcgaaggtatgtgcagcctcatcaggttttccatgacccccctaagcattactatacacttccgaacctctcatactcgccaccaaatcacccaaaaaagcgagcacgagtatcacaaaatctccaccagcctccgcaaaattttcaatcaccttgttacccacatccaagccaggggtatagaagggaacaaaagttgaaagatagttttacaccaataggagagtcctatgcaagcttatttgagaagttaaaacaacatgacatgattgccctcattcctccaaatcaggtggactgacgtgcgagaagctttgactcatctaaaaggtgtgaataccactccaatgctctggggcacaatgtggaaaattgtcgggatttgaaaagagaaatagaaaggatgatccaggaaaatttgattcaagacggtggcacccagaatatcgcgttgcatcccttacatgaggaggcacacttggtagggatgatgctcggtgacatggggtatgagaatactcttgggaatttgttgactgaagttgaaaatactgaagcagatagtggtcatggcaatatgggctaagatgccgtgtttttaattggaaagacgcttcattcctaagtcagctggggaagagctttggtggtctatttggctgtcatttctgttgttcggattatttgcagggttgtaatccggatattgtcttgtgttcaaaccctcctatactttcatttttgtctagcttgtttagtcgtagtggtttgtctaggattgtctaggtttgtttcagttcattctagggttgcaatccagtttgttttgtttttgttttgttattcgaactgtttcatcgtttgtctaatgcaaatttcgatctgttgttcctcccaatcattttctttgtttagttcttttctaactttttgttttgccttttgccggttctagtgacatgacatgcacgcataattctcagtctgatcttcaaaagtggcgaagcaatgagaccattttgaaaacgataaggacacttgaagaaatgagaacagattggtacattttgagattgtttgacacccgaaccatgtgaaactggggcaagtaaaacataaaaatccccgtaaaagcaagttggccaaattgacagggggtcggtcgtggtaataatagtaagagtgttgtcgaatggcacattatatctgacagatgtagaaggaaaatgtgtggaaatagccgtcaattccgatgcggtcaagagatgatgtgtatggtttctttattctgattgtacttgtttgtatttggcatattttgaagtttgaaatgatgaaagcgttttgttctgctatctaaacactttacccttttgtcaacctctttgagccttatttgttttctttcatacccctctttcggaatcaacaacacaattaaagaaatgcaagtgccggagatacgcaaatggaaaaagaaggaaaaagaaaaggaaagaaaaaaaaggaaaaggaagaaaggaaaaggagaaagaaagaaagaaaggaagaaagggaaagaagaaaaaaaaaggaaagaaaagaaaagaaaagaaaagaaaagaaagagaagaaagaaaaagaaaaatgaagaaaagaaaggaaaaagaaaaaaaagagaaaaaaaatcgcaacaacgtagtttctatgatgtgaactacgtttgacttgatcccgaaagggtacgtaggcagcctctctgaggttcagtcataccaaaacaaaaatccaaaagtccccaagcaagaaactggggcagaaattgtggttgttgtgagaagtcggattccgaaagttgtaaatttaacccattttaaaattgttttgagccttttataccctttctttctaacccatccaaaagcctacattacggtccaaaaaaagaccttctgatcagtctttgagaaatgccaagtcaagcaggtaaggtaattcatgtcaggggaaacactccggtccaaacaaggaaaatgaaaatgagagaatcttattgataaaaatcctcatgggtatcgcaaggtgatgaaagctgagagaaataaaaaaaatgagagagtcttattggtgaaaaccttcacgggcaccttaaggcgacagtaagttgagagaaagaacgaaatgagagaggtttgatggtgaaaaccgtttggggcactacaagccgaataaggaatgtgaatcaaattggataagtggagcaatgaagcccaatttcatggcaaaaaggaacaagagatgaacatcagatttgcttaagagaataggtagcaggtgcatgtcaaggtcattagagtcggtatccacatccgataggtttctactgtgtagttttcttgttaggaatcatctctttctattgtcctttactctgttacttttgttttgtttatttcccctttctgagtcttttggtcgtaacagtgaggaatgacttcaaaattggccaccagctttccaattgcacaaaatggggtcacaagtcaggaaaaataacaagagcactgagctggtaataatccacatagtttgggatctttatgaaacacaaagtttggtagatgtcggttcaggaataatgcaacagatagagggtattgggattgaacggggaaaaagggtatttcagtgacacagatgacggggaaagtggttaatcagtaaacatgcaagacattcaagaggaatcagttgtcgcagaaaacatatggggtcagataagaagactagaagtaataattgagagatagtcgtcaagaagggcgaaagttattagccaagtttcaaagatggtgagacaacgcaaagcatggaaaggagaaaaggaaagccatcccagcgggagtaccacaaccaaccaccgcacttttaaactgacagaattttctttgatttgaaacaggggcatggaaatgttattgatggcataaagatatgctacaggaggattatcaaactggggcagaaaattttctgtcgtgttgaaatttttttcgggtacccatctgaagaacatgaaggtcaatacaagtgttttaaaaaaaaaagagaaaaagagagggaagtagttttcaggaaagaaacaccagttctaagaaaagtaatttttggaggaatgaaacactagtttttagggaagtggtttttttgaaggaggacaacatcagtttttaggaaagcaattctgaaggaagataattcaagttagtgggtagataaaacaaaatttgaaggaaaatggttaaaagaaatcttagtctgttgaatttctcacctaagataaagaaatcttagtctgttgaatctttcacctaagataaaaatcttagtctgatgaatctttcacctatgataaaggcaaaagttggaaaaacgaaaggaaggcataatttaaagaagaggaaggcagaagtcggaaaaaaaaaggaaggcataatttgggaacaagaaaggaaggcagaatttgaaaagaatagatgttggaatttggaaaattaagaaagtcgacatcacacaaaaacggacctagtctgatgaattatctcctagagtcaaaatctcagtccgatgaatcttcctcctgagatcgcacaaaaatggacctagtctgatgaattatctcctagagtcacaatcttagtctgttgaatctttctcctaagatgaaaatcttagtctgatgaatttttcacctaagataaagataaaaatcttagtctgatgaatttttcacctaagataaattttaaattttaagatacatttcagtctttaaatttttaaaagttgcattttagtcttatcacaattcaagttttagttcttattagtatgtggtaacaaacacccagttttccaaactggggcagaaagtcttctttgttgtgtttgttttgtgaagtcaggagcccgcctggataacaggggaatacatttgaagtttgaagtcaggagcccgcctggagaacagaggaatacagttcaagttttgaagtcaggagcccgcctggagaacagaggcatacatttccaattttgaagtcaggagcccgcctggagaacagaggcatataatttcaagattcagaaaatcaggagcccgcctggagaacagaggcatacaatttcaagattcagaaaattaggagcccgcctgaagaacagaggaatactttcaagcgcaacagtcaggagcccgcctggagaacagaggcatacatttccaattttgaagtcaggagcccgcctgtagaacagaggcatacaatttcaagattcagaaaatcatgagctcgcctagagaacagagacattcaatttcaaattcagcaatcaggagcccgcctgaagaacagaggtggtacaattcaaattttagttttcaatcgactttttgtctttttgaagtcaggagcccgcctgaagaacagaggcatacaattcaagtttcagaagtcaggagcctgcctgtataacagaggtatttcaagtcaagttttaatcaaattcttattaatatcaagtaacatgtacccagtttccaaactggggcagaaagttttcttggttcgtttatttttatgaagttaggagcccgcctggataacagaggaatacattcagttcaagttcagtagtcaggagcccgcctgaataacagagggatacattcaatttcaagtttcggaagtcaagagtccgcctggagaatagagacatacaattcaagtttcagcaatcaggagcccgcctgaagaacagaagtgatacaattcaaatttttagttctcaattgatttctttgtctttttgaagtcaggaacccgcctgaagaacagaggcatacaattcaagtttcggaagtcaggagcccacctgaagaacagaggcatacaattcaagtttcggaagtcaggagcccgcctgaagaacagaggcatacaattcaagtttcggaagtcaggagcccgcctgtataacagaggtatttcaagtcaagttttaatcaaattcttattaatatccagtaacatgtacccagtttccaaattggggcagaaagttttctttgttttgtctatttttatgaagtcaggagcccacctggataacagaggaatacattcaaattcaaaattcagaagtcaggagcccgactgaagaacagaggaatcattcaagtttagcagtttgaagaagggaaaacatctcagtttgcaattcaaaatggaaacaatggatttcacctggggagcaagggaagacaactcaagtttcaagagaaaatggttcaaggtgccgagcaggtttgacctcgaggcacacgattcgagatggcagaaagaatgagtctcaatccaaaacaaaggaaagaagaaaaagaaaaaaaaagtgagctctaaagttcagaagcaggaaaatatgtgaactggtcaagacatggccgaggtcacaagcactacatgtccggtcctgacccaaaagcagtagaagaaggagctagcacctgcagctaacaagtgtcaaggttcaaatctaaagtctacataaagaaccattcaagactcaagatcaagcttcagaagacttatagataggaatcttgtaactcgtagtcgataggcttagctagtctttttcatcttttgatttttgatgtaataacagggaccgcagaccggaacctcgacgaaacggcacctcgaccggatctctacctcagcatacgctgtcatctcactcatctctgaactacacgtgacctgattttatagccaaggatatgtaggcagctcaaatgccagagctcggtcacatcccccttttctcttagtcttagtctctccaaataagggtcgggtcaaaaacctgtctagtcagtctttgtctgaaaactctgtacgtttccagtcaaagaggggcagctgtagacatgtgatttttgaccctccccaagatcttttatatattagcgtaaaatatttaatttaggcataatatagatattttaagtaattttgactcttttactttattttagtacaagaaaacaaaaattacaaaaaataagttcattaatattttgtagtcatttttaatctaaaaaagaatatataaaaatagtatcgtatttttatttttaatataatgtttgaaaatacaaaaaatagatttggtttaatggttagttttgttttaataattattttaatagtaggactaattaataaatgtgcgcgtatttttaatctcattcgcggcaaaagaatagagcttgggctagagcaacccatctttaggcctaattttggacctagcccacaattgccaagcccataattcctaggcccataccccttaacataaaaccctaccactaacctagacctatatatattaaacaaagcctaaaactaaggggggggggggggggggctaaaggaaaagcagcaaagctgcgcatgaagaagaaagcttattcgtttaagaagctattatgagcagcagctagaacgagttgcgcaacacaaacgacctccccccgaccatcatcttcttcacgacccaccatccctgcgtcgtcttcttcacgacccaccacccttgcgtcgtcttcttcgagcacacggcccccaccccctccacgtctccgtcttctccaaacgcacctcactgtcgttctcttcttcttcagtaacaaccagcatccagcagctccatcgacgaccactgttcagctcaccatcgtcgccggacctcttcacgtccaccaacgaccatcctcacgcaagcctgaaccaaacagccatcactacctttttccttcagctataacacacccaaactaccccagccagcaactactctcatgcctccaaactccatggaagcagctgaatagagctccaaaatgagctgacaactcccagtaaactcgcttgtaaaccactccgaaggagcctcgaaaaacagtccaaaatccggccaggaatcagaaataaaggagcgtctcgtttcttgcccagattcgccgaaaaatgcgcctagttcatctcaatattgtttcgttcaaaatccaacagagtccgtttggttttccatctgagttcctattttttcgttgaggtcggcaatttgtcgaggtactgtcgttggttttcggtttgagttctgtctagaggtcgtcggattcatctcttttatttcccatgtatggttagtttctattttattgtgtcattgataataatactacattggttggtcaatatttgtcaccggagaaactccgtcgctaaggtttaaattttgttctttgggtgtcttcttggagcttttatatgaggtttcatatcatatgatttggttttgttgttgtaaatatgtggtgttcgatgttagcggctaggaaggacaataatatgacgtgtttgatttgtttaaagatgtgttaattctgtttgaagttgaataagcttttcataggagatgacagtccatttgagggctaccttgggaatttattgtacttttactcttttatggtttctagtcttctttggattgtaacagtgtggtgctactagttttttttctttttcttttttttggtataaataacgtactattttaaaaatgtatttggataggtttaaaagtttcatcttaaaaaaatagtaaatatagctttgggtttgggcagggtcgtatttggtattgctttattattttgatcgttacttttgggcatgctcttaatacatctatcgtgattgtgtacacgctcgcgtgacataattacgattctaaatcaattcggaatatgcgtttcgcaacatcgagcaagctttcttaaattgttttaataggccgaagtgcgccatgtcgaataaaattccaaaactcatggccctcatttatttatttactttaaatccttagaaatcgaggtatgccatttagttgaaattccatggccctcgcaaagtgcaaacgcgtagttgctttaaacgcgctcttaatagaattaccttcctaaactcgggtgcgcattgatgcgacccaaatccaaatctcgatgaagttgaaatgtgttcacaatcacgggcgcattgattgtgacggggttcgaaacgcggttttacgacatcgtaattcttataaaataaataatgatagaaaagaggttcacaaattgagacgagcctcaccacacaaaaatgaataaatgtggggccctcaataaatggttattaaaaatgattagaatttgggatgaccatttagcgaacttcacggtcttgcccaaaataatattacgttagaatctttaggcgcgattttaattaaattaccttcttaaactcgggtgcgcatcgatgcgacccaaatccaaatctcgacgaagtagaaatgtgttgacaaccacgggtgaattgattgcgacgtggttcgaaacgcattttcacgacgttgcaatttttttaaaaaaataattataataaaaacggttcaaaattaaattaaagtcacataagctagcatgtattaaaattagataaaatcaaatacaacagttaagcgaccgtgctagaaccacggaaccggaaaatgcctaacaccttctcccaggttaacagaattccttacccggatttctggttcgcggactgttaacagggtcatatttttcctcggttcgaagattcaaccggtgaattgggacaccattaatctcccaagtggcgactctgaataattaataattaaatcccgttccgattgtcttttaaatggaaaaactcctttacgcctttgcgggtgtagtgaaaaaaggaggtttgacacccttgactgtcgatctcgaactgcttatgtccttctcgggagcttcgtattattcttccattgagtcttggacttccgtcctctgctggggattcttgttgtttcctgctagggatttcggctgtattcctctgctttactgacttgaaatgtattcctctgttatatgggcgggctcccaacttccaaacttgaaatttgaatcgccattctgttcttcagaggggatcctgaccgctacaaaatagacaaaacaaaggaaactttctgccccagtttgcactaggaagatttgtgaattgttagcaatattgtaaaccacttatactatatgcgatggtgagagtaaactaacgactaagccaggatgtgcatctcctatgagtaaaacccgaaactctaacaagcaaatgcgtttgctaaaaataaaacctgaatgaaccaaactaggaagtgtgtctcctacgagtaaaacttgtatgaaccaaaatcaggaagtgtgtctcctagtggtaaactctcatctttaggaagtgcgtctcctaaagcaaaaatataacccgaaagacccagactaggaagtgcgtctcctaggggtgaaacttcaatgatttaaactaggaagtgtgtctcctacgagtgaacttaaatgaaccagactaggaagtgcgtctcctaggaggaaatctcaatttaggaagtgcgtctcctaaagcaaaaaatataacttgaacgacccagactatgaaatgcgtttcctaggggtgaaacttcaatgattcaaactaggaagtgtgtctcctataaatgaacttaaatgaaccagactaggaagtgcgtctcctaaagcagaaatataacctgaacgacccagactacgaagtgcgtctcctaggggtgaaacttcaatgattcaaactaagaagtgtgtctcctatgcatgaaatcttaatttagacaatgtgtctcatatgcctgaaaataaacttaggaagtgcgtctcctaggggtaaaaataaacttaggaagtgcgtctcctatgggtaaaactttaatgattttaaactaggaagtgcatctcctattaatgaaatcttaatttaggaagtgcgtctcctatacatgaaatcttaatttaggaagtgcgtctcctatgcatgaaattaaacttaggaagtgcgtctcctaggggtaaaaataaacttaggaagtgcatctcctaggggtaaaactttaatgattttaaactaggaagtgcgtctcctattaatgaaatcttaatttaggaagtgcgtctcctatgcatgaaatcttaatttaggaagtgcgtctcctatgcataaaattaaacttaggaagtgcgtctcctaggggtaaaaataaacttaggaagtgcatctcctaggggtaaaactttaatgattttaaactaggaagtgtgtctcctattaatgaaatcttaatttaggaagtgcgtctcctatgcatgaaatcttaatttaggaagtgcgtctcctatgcatgaaattaaacttaggaagtgtgtctcctaggggtaaaaataaacttaggaagtgcgtctcccaggggtaaaactttaatgattttaaaccaggaagtgcgtctcctatgaatgaaatcttaatttaggaaatgcatctcctatgcatgaagataaacttaggaagtgcatctcctatggtaaaaataaacttagcaagtgcgtctcctatgggtaaaactttaatgattttaaattaggaagtgcgtctcctataaatgaaatcttaatttaggaagtgcatctcctatgggtaaaaacaaacttaggaagtgcgtctcctaggggtaaaactttaatgattttaaactaggaagtgcgtctcctattaatgaaatcttaatttaggaagtgcgtctcctatacatgaaatcttaatttaggaagtgcgtctcatatgcatgaaattaaacttaggaagtgcgtctcctaggggtaaaaataaacttaggaagtgcgtctcctaggggtaaaaataaacttaggaagtgcgtctcctatgggtgaaactttaatgattttaaactaggaagtgcgtctcctatgaatgaaatcttaatttagaaagtgcgtctcctatgcgtgaaccatttccttcttcctgaattaccttcttacagaactgctttccttaaaaacttgtgttgtcttccctcgaaactgctggggataacactgctggggaattatttacttacctgtcgggggataatactactggggaaatctcctttattccccttttttccaaaactacttccttcaaaacttttctctctcaacattgctggggataaaatgttatcagctggggataacgcagtcaaggataacactattgaggaattttgattccttcaaaactagtgcttcattcttctgtaggttgctgggaatgacactggccttttgttttttctgagcacaagtttcatcctttcgttctgtccgttggggaacaacttccttcattaaaacttgttatactgggggtaactctggttcaaagaccacttcccttgagactggtactatctttattcttccccaaatgggtacctgacttccagaaaattttctaaatgaaaggaaaattttctgccctagtttggtaatctctcttgtggcatgcatttccgtcatcaatgccatttcctttacctgtttcaaatcaaacaaaatttgttagtttaaaacttggtggttggttgcgatactcctctggggatggcttttccctttctccttccctgctctacgttccattacactatcaaaacttgattgggatgatattatttgctggggatgatattcctgctggtcttagaacgacttgccctgctttgcgtcgttcggctatcttgaaacttgggtgataacatccgaccttattgtcaattccttattcaccaacctctcaacgttgttttccatctgaccatgtatcttttccatgatagttgattccccttgaggattttgcaatgttttgctgataaaccacattcttttttctgctggggatatccctcttcttttgtggcatcgctcggaaactggcatttccacgaccttttagtctcatatgaatttctcaaatcatgcccattgctcttcgcgttgttctttcttgatttgtccgcgggctttggccttgaggtttataacctttgatttcggcggggatatccctcttgacactcgttcatccttttgtcaatcatcttttgctggggatatctttcttgacactggtctcgcgcttgttccttcctgacttagaccatttggatgttctaatcggatcgggtcttgcataattggaaagctgatggcagattttgaagtcatttctcacttgttctgaccaaacagactctactgggaaattttctatgaaaggaaaaagataaacaaaaaaggaaccgaataaaagacaaaggaaaaagatgtctctttaacaagagaaactataaataaaaacctatcaaacgcagataccgactctaatggtcatgacatgcacatgtggcctatcctctgtcgtcaatcgtctttcaagatcttcatttggagattccccatttgattctcaatcttattcgacttgtagtgcccgaagggttttcactatcaagcctctctcattttggtttttctcttagttttcatcgccttatggtgcccgcgaagatcttcaccgataagactctctcatttgtattactttctagctggggattgtggtgttacccataagactctctttttatttcttttctattgtggattaaagatctttctgctatgtatcagagtgttatgttcaccggtaagactctcatttgtctgacttgacatcctttgaagagtgatcagaaggtctttctttggaccgtaatgtgggattttggataggctagaaagaaagggttttaaaggctcaaaaacaaatcaatttggggttcaaaattacaaccttcggaaccatatttgtttacaacaagcgcaaatcttgccccagtttcttgcttggggattttttaattttttgttacactatgaccgagccgtgaggcgcctacgtatcctctttaaggaatcaggtcgaacgtagttcacaattcctctgtctttttcatttacctattattttcttttcttttctttctttttctcatttctcctttctcttttgtcgttttgttgttttttttcttttttttttcttttcttttctttttgtttaccttccatgcttgtgttttctagtcgttgctactggttctgaacgaggggtacgaaagaaaaaacaataaggctaaaaagggttaacgaaggataaagtgtttagatagcagaataaaatgcctttgtcgttccaatcttcaaaacatgccaggtgcaaacaacacaattaaacaaagatttgtagcctcttctgatggtgctggacttgacaattatattcacacatttgctttttcatttgtcatatctaaagcaccgttaggcaacactctcactctcgaccctcatgtcaatttggcgaatcctgcctttaacggttttctttatgttttacttgccccagttccacatgactcgatctccgaataatctcaaaccgtccttatttcttctaaatgttctgatcacctctcaatggttttatgattaccttttaaggttaggcccaaaatgtgtgcgcatgtcatgtcactagaatcgacgctaaacaaaatagtaaaagaactaaacaaaaagatgattggaattaataaaagaccggattttgcattagactaatggtgaaatggtttgaataacaaaacaaacaaaacaactggggtacaattttggaccaaacctaaaacaaatcctagacaacactaaacaaaccactatgacaaaaatggaatgataagagggtttgacacaagacaatgtccggattacaaccctgcaaataactcggacaacagaaatgacaacaaaataaaccaccaagactcctctccagctaaccaagagatgaagcgtctttccgattaccaagcacgacatcttaatcactaggttccctatcgatattgccaaaaccattaacaacttcaatatcgttaacttcagtccgcaaattcccaagaggattcacatgctccttgtcactgtcattgatcataattaccccttcttgaatcattctttctacttcccttttcaaagaacgacaatcttcaatgctatgcccttggacattagagtggtacatgcaacgtacagtaggatcaaaaccttttgcatatgggtctggagtatagccgaggagtggctcaatcaggccggaatgctttaacttttcaaacaagcttgggtaggactccccaatcggcgtgaaactatttctttgcctttgttcccctccctgcccctgttttcttgggtcgttgggtgctcgaaaacgttgtgaaggcaagaatgaattacgtagtgctggcgctcgccatagggggtgacctgatggttggacatgtgaccggacattgttcggaggatgatactgaggtggattatgtggagctcgggggcaggtttgggcataatgggcggaaaaaagtggctctgatggtgggtagtagggttgtggaaggttgtatggagtgtgtggataatttgggtgatggggtttgggatggtagtgaggggaaggacctctggatttggaccaagtacctgcttcaaccgttgcgaccttctctctcttctttccgagtgcacctcccgcgccgctctggatggcctgagtggttgctttaatcgccgaatagctcaggattttgttggatctgcgtccctcttcgataataccgcccatttttactacttcgttgaaagatttaccaactgacgtcaccaggtgaccaaagtaagtgggctccaaagtttgtaagaagtagtccaccatttcaccttccctcattggtgggtcgactcttgctgcttgttccctctaacggaatccgaattccctgaagctctctccaggctttttctcaagttttaacagtgtgagacggtccgggacgatctcaaggttatactggaagtgacccgcaaatgcttgtgctagatcgtcccaggtataccacctactaggatcttgtcttgtataccactccagtgccgacccgctcaaaactctggccaaagtaagttattagtagctcatctttgcctctcactcccctcatcttgctacaaagccccgtatatgtgccataggatcgccatgcccatcgtataaatcgaacttgggcatcttgaaccctgctggtaattggacgtcagggaaagggcatagatcattgtaagccacgctgacctggttgcctaacctgtgcatgttcctgaaggactgctccagatttttaaatctccgcatcacctcatcctgctctgggctcttagccggcttttcaatctccgccgggacctcaaagtagggattataggtatgtggctcgggtgctttgaatgtgagttcagtgggataatattgcgcattgtgagcttgaaacaatggctcactagacgatctgtgcaatgaagctggggaaggcgccacaaagacgggaacatttggtggaggaggattctgattgggtggtggagcttggggatcataggtctctcctccctgatagtagtgatggcttgggaaactcgttgaagggccggtggaggggtattccggcgtgtgtcctggtaggagagtaggagtaacgggtagttcataccccttttgggctctagctaaggctatctgcatttcattcatttccagcctcatcttttccattttttccatggcctccttcaacatctgatttgtcgtcttttctgactcaacactgttgtccgagccagtcatgctttctggtatggaccattttgatcttgtttgataatggtacggtgtcagtacgctttaacaaactaactggtatagattggaaaaacaacaaactcgtcagtgttagagtcttaatagatattgtaattgcacgttgggggatgcaatgttcttaggcagttaaccatttctaatatgcttttgctctgaccgcatgcatcatcccggcttattttatttgtgcctctttcgagtgttttagagacctctcttttcttcttctctctatcttttttttagtgatggtcgaatcttatgtggattgcctacgtatcatgtccccccatgaatcagaccgagcgtagttctgccaataaaagataaataataataaaacatttttttgcaattttcataataaaacaaacttgattataaaagtttaaaaactgaccatactaacagactttgacaaaagacaacaaacggactagaaaatcaaataactcgcacactctaatcaaagaattacaaactcaaaaacaaacagccagattccttcccctatatgccaattttaaccaaatggttatttttcagacgtggccccttatcaatttcacatgaattttaaggccgggaaggactattttacgacctttcacaaacttgttcgttcttttacgaaaatagcccttcgacgactgaaagatactctaaggctatctcggcaggaacggtttaagacatcaccgaagccgggccggcttattttaactaaaaaccaaacggtattcacttgaccactaactattttcttgttttttcaaataataaaagacctggttttgcaaacacaatctttcagcacttcggagatgaagattttaagattgtgcgggataactggtagcaacccaaaagaatgaccaaagatggtcgtttatgcaaaatcagccttccggcgtccctttcgagaacattcggctatttttgacaaaacggcgtgacccaacttatttatgactcttttcttgtttttttttcaaattagaataaaagacccggtattgcaaacacggcctttcagcgcctctgggacgaagattttaaggctgcgagggtcaaaaatcaaaacataaccaaaggtggttgtttatgcaaaatcagcctttcggcgtccctttcgggaacatttggctatgttttgacaaaacagcgacacccgacttctttatgatgaaattaaaatttgacatattttttggctattttagcaaaaggggaggttggacccgattagggctgcctacgtatctcacatccggtgagaatcaaactagcgtagttcgcccagataaactaactaaacatattttttcctttttcttttatagcaaaagaaactatttttcctttccgtttttttatttttttaaaaacaaagcaaactaaaataaaggactatttcatacacactttctgctttttgggtaaacaaattatttttaaaagtaaaatatatttttttcgtcagagttctgacagtacttggacactggtttttttctaaattaatcatctaactctctacttgctatttttctctttttctcaatttttttccaaaattttctaacattcccctagattcagaagccggtcaacatgcggtttcaaaataaataaatgcacaaagcgtaagtaggatgcatcaggatggtcttttctgtttcaggttgctattcctagacggacccagcccctgtgttgagtcccccaagtcaaaaatgcacatgatgcagataagcgttcctactagggatccggtatgaagatgagttattctaggttcagaacctgggtgtttgttttagacgtggcttacccgagcggacagctcgagcctagggggcagcgtaccgggaatacagaagctcaacccggctttgcaacttatccgaacctcgttctaaaaatgggattgactctaaacagaaaagaagtcacacgaagtgcacccttcttcatgatttagaagactcagagaggatatgggttttggcacagtttatatacagttcacaaaatatcaaagcggtaaaagcagttagttagcacattaagcacagatcatgtaacaaaatcaaataaagctaaacacaacaatttattctaagcttgatttctaccctgaaccagtggttctgggttcatatccccagcagagtcgccagagctgtcacacctcctttttacccgcgccgcaagggcgtagagggagttttttcaattaaaggataatcaaaacgggatttgtttatttatttcagagtcgccacttgggagatttaggatgtcccaagtcaccaatttaatctcaaatcgaggaaaagaatgactctgtaatacagtccgcgaacaagaaatccggataaggaattctgttaacccgggagaaggtgttaggcattcccgagttccgtggttctagcacggtcgctcaactgtcatattcggcttgtttatctgattttatacaattatgagctcatgtgcaagttttaactctttaccgtttttattattatattttaaaaaagaatgtgaacatcgtttaaaaaatatgtctttggattgtgtcacatgaaatgcacccgcaattcggaacacatttttattcagtgttttgggatttggatttgggtcgcatgaaatgcacacccgagtttaagaaggtaagattattaaaatgcgcgcctaaagcgattagcgtattattattttgggtaaggccgtggagttcgctaagcggccgatcccgagttctaagtaattaatacatacatttgtgagggccccgcaatctatatgttttactaggcgaggctcatctcatttttttttatagacaatcctaaaatgactacatttttctattaaaattagtttctaaaataaagaaagaaaatcctaattaattaggagctttcaaaaaaattaagaaaacgtaacatactaattgctagattaagacaaatattaatggaaaggaactttactaaaaataaagaaaaaaagcgaattcgaaatcataaataaaataagaaattcgacaactaatattcaaaagaaatcaaatatagctagattgaagctcgcattgttatataaaaaaaactattggaattaattattcacaaccatttgaaactagatttaaccataattactaaagcttattagaaagtttattaaacttaaacattatctagtcttgtttggccttaactaaatttagctacccattcatgattaacctactgttgaccatattaaaaccttcatagctaatgaattaacccgttttgccaagctgattcactaaagaccaatttatgtcattttcctcttattccaattattaaacagtaatacatgaaatagcctaaatacaatcagtaaaagaaacgaagaaaaagcgaaattaaaatttcaaagttccattcttcatatgtattcatgctttcacattttccgcttacaatatcgacaaggttacagccatgtacctggtattgaatacaagagaagaggaagatgagaatcggcagcagtattaacaatacaacacagcaacaacagtccagcaacacaggaatagaccagtaacagagtttgcaaaccggtggagtagtaacccaagaaagaagcttcaagcttcaatgaaacaatagcaattaatgctgatttcaaacaatgaaggaaagtagaagattttttttcagttttgttctctcccccctttgttcttcttcctttttcttcaagtgtcaaatgagtccttttatacccaaagcaagactaccttttcttttttacctcttttctttttccccaatattcttctactatgtataacttttaactttttattattacctatactatttctgatttttaacttaagtaaaagtagtcaacacggaccccacggttcccctctttttgaatggtcaaagaagacctcatcattatccccttttctttttactttacatcattatgtcttgtcccctactatattaaacaattatatcaacccaccactacctcatgtcttgtcccccaccaggtactattttaattttgttaatgcctagtggacagagcactcagattaaataattgttcaaatttacaattccaaaatacccctccaaccttactgaaattaccattttacccctgaaagtactacaatttaccaatctacccccatcagttataaccaattcacctaatcaattccaaccaaaatacaacaaatataaccaattcctaaacaaattcaatcaacaaatcccatgaacacagattgaatcatacaacatcagattaatgggaataagttaaccatattgggaaccaatcctggttaacttagacaaaaaatgaatgatcaatgagacaacaatattagcaacaaaagtaaactgaaacaacatgaatcacaattaactgaatcgaaatgcaaactgaaatcatatgatgaataacaaagagcaggaaaccaaacaatacacaaaacaaaattatccgaaccaactcaatattaacaaagatactatacattctacaactaataatcacgaatgacaaaccaatcgaactcaaattcgactaaacagaattcaaagaaattttttacaaccaagattcaactaagaacgattcaaactccttaaaccataatatttaaacagattttagcggctcttatcttactcacatatagatcataaaatgagaaagggagatgagacggaccttaaaaacctttaacaatccggacctcgactgcgtatgaactgtttcgacgaccccgaccaaagctcgaacaaacgagatggtggggtctcgttttggactgaaggcgatgaaaaaaggtgaagcagtagcgatgggaattggttttgaatcagatgctcgatgaggcagcagcaacgcagcagaagcagatgctggacggagctaaggcagcagcaacacatcaggtgcaacttggttttgaagcagacgaggcagtcgtgggaggtgagacgtttgggtctgctggaggtcgacgagctgttcgtcgtcgacggctggatgtagcaggagcagcagtggcgatggagcagtggcagcagggttgggtggtgctacatggtacaagggtgagagacggtgaaggtgacaaatagcttcctcatgcttttgttctgaggctgctaggttttggttttaagttgtctaggtttgttttgtgaagaagatgaggagctggtgggtcaactggttaatgtcgcgaaagtttaggggtgttcttttaggttgagatgaaagagcagcagaggctgtttggcttaggagatagacgatggtggtttgtgtgttcgagctggaggtcgtgaggatgatgaagaaaatgaagcagaggggtcgttcatggtggtcgacgaagaagatgaagcagaaggcgaggtgctagggtgctgttcgtcgagggaggcagccatgggagctcgagctcgagctcgacgacgaagaagaaagtagcctgcttggcttttggtttggagttgtgtgtgtgtgtgcttgtgtcgaagaagacgatgcaagggcagccatggatgggggcgtgagaaagcttggagaagatggagagaaagggagggggcagatgggtttaggtttagggttttttttgtaaaaaaaaatgaaaatgaagtgaagataggaggttgggtcatttggggttatggggcggacctggtcgggtcgattcggtgggtctttgggttggataaggggttatttagtttgggtagaggtgttttgggcctaggttcaaaattgaggaagagacccaattccgatttttctttattttttgctctcttttcttttacttctaattaataaaactaaaattctaaattaagttataaactaaattaacttatcaaaaatactaactaatttctagcaacatttatcacacataattaaacactcattaaaacaaaattgcacaatttgacattgaatgctaaaaatgcaaacgacgcatatttttgtaattttcattcttgtaaaacaaacttaattactcctaattgtagaattaaatcctaaatgcaaatgcgacatatttttgtatttttattaattttaacaaataaacatgcatggacaaaatacaaataattaccctaaaatgccgcgaaaattctcaaaattgcacacaaaggaaaatcgttttattttgaattttttgggagtaattctttcatagggcaaaaatcatgtgcttacaaatccgtgattcagttttgagtttgatgacacccctttatgtaaacttataaattttcatgtgaacctgaccggtgaattttatatccgtcacatgaaatagtttaagtgggattgtaaaggatttagttagtagattaaattaaattatcagtgatttaatttaattaactagtatttgtaatcttaacatagggagttaaaataagtgttaatgattttcgaaattcatattgaggagttcaattgcagtttttagtagcacaaaatgcgattaattatagtaagatttaattcttccgaatttcgaattaatactatatttggtagcctcttattatttttgtagtccctgctatacctagtaaaaaccttaacacacttggataaaatgtgacttgggagaaaagttatccttttggagttagagtaggattttacttgcactagtagaatcctacatgtttttgagccttttttgggcttaatttcgggtctacgaaaggaagaccagtttcacccaataactcactcttcggagttgtattatttgcccacacaaataatttcgtctgaggtcttacaaggagcatagcagaagactgcattcctggattcttgctttgtggaggacttgtgcaacgtttttgagaggttagtgtttctaatctctgtaattatatcattgtctagtttacatgtttgtgatacctgaattatatgcttgctttcgctgcgcatgtgctaacaagtacaaggagagcgaaaagatgaaaaatattttttaatataagcaaaaaaaaaaaacaagttaatttaaagtattgaaaaaaattgttgatgcacgggttcgtactattttattaattagatggagaaattatctaaagaagtgatgttgcatcttaatatttgcaagggatggtcaaggatatgtgatcgattgagttacaagcttgtttggatggttgttagctattgtatcgtatcgtattgttactttaaatacaatgtttgttttgattgttacttaaattttattgtatcgcatcgtatcgtatcgttaaatccgcctttacgtaacgatgaaatgtgccactttatgtaatgaccgatttggtgtgatcgcgtcgtttccttgtgtttttctctcaatctcaccctttattattattaaataattttattttatcatttatcctacctttttatatactgtatcataatttttctttataatattgcaagtttattcatcatattactggtgcgtgataccatgaaatgacggcaaaatcacacaatccaatccatacaatacaatacgatacgatacattatgaaacgatatgtaacaaccatccaaacaagctgttaaaagaatactgaaacatcgcattgtttaaattgattatttaattaaaaacaaaagagtaatcaacaatattatactttttttaatatacattgaacaaaatcctaatgtggctgtaactttagtctttaggggtattaacaagtgatattgaaaccttgcataatacttctttatttatttagttattcgatatgtgaggtgagattttcaaatgctaagtccctgaaattcattactaatatttttaatataatatattatgtatatcattatatctatattatattaaaagcacgaaggcccttaacaaaatatcgtttgccttttttaccctttaaaaatagagttcatactggacaagatagtcatttgagtattttaatgatatttatgactttaaaatcaaatcaaatttttcctaaatttttggacttaaaaacaattaagattttatactatataaagtttccttacttaacataactctaacctaatacgttttctttgcttgatttattattgaatcttaataaaatcctactttaggttagaaaaccatcaataaaagaatcctaagaatgaacgaaaagttgagttctgccacaactcacaaatctattgcttatcagattagactctcaattatgttgctttaccgactttaaccgggtctgattctccgcttaatatcaaactaacttgggatatttaacgttttagtttataaatttgattatgcattgtttgttgcgattcatgtggggtttcaaggatttatgttacctattggtatacctcatggttttagtggatctatgtttctataattttcttatgtttctatattcttgagagctcaatggcgctttgtgtgtcattgctttgaaagaaaaatgcattagtatgtttcttacttgcgtacaactttagttggtagttggtactactttaatgctagggatatgtagttatgcaccactcttagtttttgataatttttatatccatagattgtatgttagtacattcagtcatgtcactctaacgacacttcatgtagaatcataattccaatatatgcattaagtgagtgttaatttgtactaaggaaaagaaacgaaactgaaaatcattcaaccttaattctactcacatagaaaaagttatcctagatctctaagtacaaagatttaaaaattaagaagaactcatattgataatcattatgcaagacgcaatcccaaaaatattactgcaagagttttaacttatattgtaagtgtaatattcatctttaagttttatagcaaattatagatcttactttttttatgaatgattatttgtagatttttgttggatgacctaatagtataaatatattttctaaactattggtatattcaagttatactcgtgttcaactaaaattcttttatctccaatttagttctatgttattgctgtttttttttttagaaatttgtgattcctttccgacatgcttctgatcaactttattagttgaatattatctatttgatgctttcttacattgtttgttagagaaaatatataacagagatgaaataaataagagccattcctaatgtgcgaaatagcttttaagatctcattcattgttcgtctaataactactagcattaaatcaggctaatgctgctagaagtatattttatacgtgaaagattaataatctctcaaatttcatattgatgtgtttattcgcttatcctcatgtttattattcgagctaattgataattttttggcaactctttttgataaaacgcaaaattttttaaggtatattaaaaatgtggccatgataaaataatgtaaatgttgttgtcatgataaaataatgtaaatgttgttgttatgataaaatacgtaaacaatagaaaggaaaggaaccagtaaactaaattaatctattggtcatgtgttgttcacaagcaatttgagttgaagtgctaggtcggtattacattgatgtttcacaccatgttctattttcaacggtaattgatcacatacttaattaaattatttttctcaaataaatggtcttagaatgtatgtggtgtgaatttatttcgttatataagtttcataattgtaacatcgatttattttgttaatattatctaatgataatatttgaattcaatataaagtctacttgattatggtaagccttacggtcttaccgtaatcatacgaacatatttagctttttgttgagctaaaacatacttggttcgttataactaaagttaaagtctacatattagaacaattttataaaagctaatcttagttaattttaaagtcttgcatattaggattttatgtatagttaaaataaggaaagatctaataaaaagattatagttgacataaaaatttaaatactaaaaaaatagttaaatgataattttgtccagtataaaatatatttttaacaggtaaaaaaatttgtcagtatcttaattttgggcgttcggtaaaaaaataagaaagatttgtcagttagttgatcctattttatatcttctataattaacatatgaatatatagtttttcaaaaaaaaatcttaatcttcaaggatatgtgtactaataataaaaaggagcatgataaccttagaaattaagtaataaaattataaaactaaaataaattttaagttaaatatattgattaatacaattgatcgacttatgcagggataaatttcttacattattgagttacctaaatatgatcaacaatcatcatttttaaaaatttaaattttttcgttaacttctaccttatacatatctcagacacaaattttaaatataacatttatgtgatattttaaaattttaacttattaagataatgtacacgcacaaatataacatttatttttttaattatttctttcatttatacattaaataactcaaagaatcaccgtagaaatacatgtgcaacgcatactagtattagaaaaaaggtgggatcacaacgtcataacacaatctattgtgaatgggaaagtaataacgagtaactctaagagcggaggcccaaattcgcaaattctatcccgttttcaaagccgctgcaactctcaaaactttggcgaaaggatggtgaaaccacttgccgattcgcgcagcaacagagccgccgttcaggccaccaacgacgacgcttccgccagcaaactgtacgtacgcctttttattcaactgtacagtaactcttcaattttcttcagttaatttcctagatgtaatttagagatatacagttgtataatagaatgcttcagagaccatctatgaatatatcattttcactgcaaattattggaaattgagctgaaatttaaacctaattatcctcaaattccgtcttatatgattactgttttttatattttgtgtgatgtgaaggtcatgcgtgaaaaagggatacatgaaagatgattatgtcaatctgtttgttaaaaaacccctgaggcgatctcccattattaatcgtggtatgatatctctttttttgcttcttaatccatggtggtgatgtgcttagtgtttattttttggggttgtttaatagatgtgtaacttaattataaggttattttgctcgctgggctgctcttcggaagatgctctatcaatttcttgattgcaacccaaatgctgatggaagtggcaatattaagaagcagatattgtcgcttggagctggcttcgacacaatgttttttcagctgcaggtgcttcagtttctatgggttgttttaatatcttccatgatgattgaaaatttcacataaaggatcccaaggcacattttgtacttttttcacaaaaaaaggattttctttttgtagccaatccaatgccctgattccaactagtttgggagttggaactaaggcaaagctgacagtatgctattgcagttctggagctttagtatggtcttgtttacagtgtctattcatgtatcaattttcctccatcttgatcttggcgacccttaaatgaagttgtcaagagaaaatggaggttaagagcaaaacgatccctcaaatgggttactgtacgtggaaatttgagcatctggttcaggctacctgcaatttttgttgaactaggctgacagtttgtgatagtagaattttgctttatgttaagatttttcttatattgcttgatgctgcttcatgtagttttccaatacaatagatacacgcttgcacgtttactgtaatttccatccttcagaaagaagattaatagctatatttgtctttggcaggatgaaggaaaagcacctcatctttacgtggaactggatttcattgaggtgggattttcaaatgctaagtccccgaattatgtcatagcataaacgaggcaatattttttgcattttggcaaatccattttactttcttggctcaaagagctcagctctagatgtttgtctcacaggtgacaagcaagaaggcagctcttattgaaacctatagtcagttaagggataaagttggtgaaatagcatcaatctcatcaggtaatgagcatgttcaccgcttgcaaatatgcaaatactcttctcttgtgaactgccaacttggtgatccctgcctttcatttatcttgggcaaatatatgatttcatttccttgacaagataccatgttgttgagcgcgaggtggatacatcaagcatttaatctctgtcatctaactttctgaaccatgtcattttttaatacaatatttgttcaattttatcttcttagtataggttgaatcagtatgaaggaaaaacgttagcttttaaagcatcttctgtgacagaagggtgttccttttgtgcaaagcggaatctagcttttattcacgactacacgatgtttctttgataagtcaaaatttctctactaaacaccaagttggatgtcaaaggaatgtacaagtaaattatcattttaactaactcgaatgtggtcatccacggtcatctaacaagtacgccagttatctttattgactttacaacaccgtattttctcgacaccagaaatccaagtgaaatatgatgccttttacatcatatttcacttatttgaagcaattttctactattaatttttcgccataagcacaaaaaaagagacagtggtgatgtttccctcttttcgctgaactctccagcttgttgttgcttcctttacttttcttggtatcactcataatatttgaacaatgaaatacaagggtccacatttgtgaagccaatatgcaatgcaacaaaagatgattagcattgtttttagtttttttttggtcacatgcaatgctggctcctaccttcaccgggtaggaataaggtctgcgtacacactaccctcccctcccagaccccacttgtgggattaactgggtttgttgttgttgttgttgttggctcacaagtcacaagtatcatcattctctttctcaagttatccgctataggatagcatccttttctgaacctactcttcatgtcctctatctgacaactccacataaaaaggtttggttgtaaaatatcttactcggtctccctccatactatcttatttccccactcaccccacccccacttctcctacagaggcatcgtatattttgtgaaatttccttaatgtcatacttataacattcatagacatggatcaccttcttaaaacatatattccatataacgccttgagcattctttctcaaataatcaattacttctgcatctttctcgtttattagaccatatacctgttaatatgtattctccaaggatattcaccgggcatctttccaaaaccttaccctacaaccctcactcacctagtaagcaatacattaaagtgaattttcctgctccttactacacttttacagtgttactccataagatcttgtctagtctctccattgttctaatatctatacttactacttagtagaaattatctgtctacataaaaggtctgctcttgagtgaatccccacaaccgttttctaagagtactatattgaatacggacaatctcctgattcccaatcccctttgcttatggaaaccaatattttcatccataattccattccacttaatgaaatgttttctccccatccattccttcttactgagaatctcacagcattttctccgaccaatttgcgccacttgcgtgcatacaaaccatagacataataagtggtgtattagcgaggtagactttcataatgttattttccctcccttacacagatattttcctattattctcccccgtcttttctcaaatttctcaaccacaggctgctacagattttaatctaattttttcctccgatcggtaaactaaagataccttgtaggtagtgtaatcaattttggtctacagatttgttgtaatctaatgatgttttgtacctcccctactggtaccaactggagtttcaaatatctacacatgatcctggcacaactttaaaccataccaaatttctgaacaagtatcgaatatgtctaatctggggttcacaagaaattaaagtatcttctgcgagtagttgatagatatggttacattatttgtcctatcaccgcctacctcgatacccttgatgacacctcattcccccgccctatgaataagtttgctaagtacctccctcacaagtagagttaacaatagaggcaaatgatccccttgtttaatgatccccttgtttcatgcagaaaagggagaagtccatagtgatcattacaaattgcttcctgtagatttgcgcaacatagacaatttaaatgatgttatagcccgtgcaaatttagaccccaggtttgtcgttgcttcattgctatattttcttaacatttttttctttaatctccacgaatgaagcacaagttatgttgaaggattttaatgtattaggtcttcctttgtcaagctcagtgagttgtgcctaaccgcctctaaatttattgctactataatggtaagtgtaatatgacaagctctgtttacatctatgtcttgactatattacaatcctggtggaacaaaattacttgatgtgaaagatgtggaagtactacaagtaatctaaattgaccagttttagattttttttttgagactggtaacaatatattaaaaaaaagaaggcactaaggcagtgcaaagccatatgtacgtgggggggatgtgaaaactgatccaccagacttacaaaaaacctaacatgacaaccagggactccgtattctttacatgcctttctttacaccaaaaataaaacaaaagaatacaattcatcttaacattctgaagagtattgtatctgtcttcaaaaactcttgagttcctctctgtccacactgtcccccatacacaagcaggtatcagtctccaccatgtcttctgactgactacacctccaatgttattccaggactttagaagctctagagtagttgcaggcattgtccatctgaggcccacaatgttaaggaacaattgccacaatttactagtgataggacaatgcagaaacagatgactgttgatctccagatctctgccacataacaaacatctcgagcataacagaaatccctttctttgtaggctttcttgggttaaacaagcttctcttgctaccagccatgagaaacaaaccaccttaaagggagcttttgctttccatatgttcttccaaggccatcccactgtatgctgatctgcatttgtaagcatgaaataggtggatttgacaatgtataccctgtttttgcaacagtgtcagaataaggtgtcctcattttcattgagccctttgaacccttccaaaaccttaaaaaatagcaattctccccatttcccaatcattcagaccccttctgaaagtgatattccaaccatgctgaccccaagctgcttccattaaaatatcaggcatgtttgcaatactgtaaaattctgggaacatctctttaagtggaccatgcccaagccaattatcattccaaaatagtgtcttcctaccattacccacccttgtgcaagtgttaaccaacacagagctccatagttgtctgatagattccaaacacctaccccataggaactgttaacaggactagtgcaccactgctcagtttgaccacatttctcccttataacctttctccacaaagcattagtgcctgagttgtatctccacacccacttcataagtaaattttggttgtgtgccttgaggtccctgagtcccagacccccctgccttttgctggtgataagtgagctccaatttaccaaatgtatggctctcaattacatcaattcctcctaagtgcatcaattacatcaggtacatcttttgggttataggcgagtacagagcacaaaggcattgtattgattttggggcatcatgagatcttaaccctgtaaaaacagtagagctgacaaaaaagagcaaggttatatagttcttttttttccccaataatggtggtgtccaggccagtttgcacgtgcctcgacgattctgcctggtacctgctacctgctacctcccactaacataggtgccggtaactattgccacataggcttagttagtggcagagaggtgttgtgacttgtgtccaaagaatcatgtctcttagcatgtaaagacttgtaacttgaaagccatgatgagctattaaactaaaaagttgggttactgctaattgtggttgcttatagttaaagattagggactacaccaggaatcttgtagttaatagtcatttgttggacaactgaaaggcatatagggtataggatatttggatacagaacaactttttcctggttgcgcttaacttgattaattggctgttaggttcttttgcagtttacagattctacgctactattcattgtattggttctcattttcttccttcatttctccacttttcaaatttataactgtccttattaaaaagaaacttttagaatttagatctatcttgtctcctttctgattcccatgttctgaaaagacttatcattgtacatgtccaagatcatacctgttaactgcacattctgatgttattatcagtttgccaacatttataatcgcagaatgcgttctgatatatttggatcctgattcgagccgtacaattgttggatgggcttcaagaaccttttccacggcaatatttttcttgtatgaacaggttgttgaagctattaagttaaatcttggattctttcctgagcctgatccatcccttggtcctattaacttgagttctactgctctactttcctaagctactgtgaatgtcctgctgatgtattataatgacttatttgtatataatttggcttattacagatccacccagacgatgcttttggccagcaaatgattcgtaacttggaggtacttttggctgattacttttttgatgattgagcatatctgctccctcaccctaactcgtttttataaactcaacaccaatgttgaccttgaaatagactttattcttcaatgtatgtgtaacaacattataattcctttttcactttccagagccgaggctgtggactactaggaatttatgctacaccaactttacaagagaaagaaaatcttttccttgatcaaggatggcaggtatttccaaagtgcaaatctgcttcttaattttgacattaagaatcaccatacctttctgtcaaaaatttaatatatctaagatgttaatagcctggattaggcctatgacttgttcctccattccaggtgtaggaggcttatttagtttttatacagacttgcagtatttccaaccatttgccttgtcatcccatctcctgtaatcaaggatggtagaagatttaattttcagctgaaactgcctttctgattgagggtcttaaaccttaaacatgatctagaagagaattattgattagcttcattgtaaaccaggaatactatccaatatgataaataaggctaataaatcatctccttaaccactaactatttaggtatagcaggttagataaaagcacatgcattagttgcttcgaacttgcattagttgtaagctcaatcttttccaattactgattaatttgaacagttacatattgctaaatactaacagtggtttagctctagctaattcattaactctatcaaagaacacatgtatttataatcaatggtttgtcttttattgattgcagaaagcagtagcttgggacatgctacgagtttatagtgattttattgaagctcaagaaagacgcaggttagtatgagttttgattgtgcttgtacattaatttataaacatgggaatgatatgaaatgatatgattcatctgaaggtgatgatttggtgctgcaatctagaggcatattactggctttaatgaccatactaagctacccaagatattccaggtttagtcagagccttagaggtctgtaagtctattttaccttcctgtctctcacccacacaaagggggagggggggggggggaggggggagggtcttcacatgcatattgtcagggtaaatgcttaattgttgttgcatgcacaaggctctaggtaacatgtttgggcacttgatctatctatacacagtctggttgttatttggtctcatcgttgtttttgtagaagtttatctttcaatcgtataggtttcttcctattcgcacagtactcttgtagctccccatttcaatatcatattaatttgtttattaactctttgtctatgtctatcatgtcttcatataatttttcaagaaaaaactgcatatagatgcttcaattgtccacaattagataccatagtgccattttatctcacttcagcgtaattcttcttatgggtgcggttgacccccgtgcagttttgtcagttaacacaatgtcatctgcaaatagtaggcatggaaccttatctttcaaggcaaatcctaagtttaaacctattgtcatgggaaactcctctcctatgtatctcctctgattattcacacttgtgttggctccttcgtacatttcttttatatgacgcttagcctggtttaagtctattgtgtgccagtctttctctctcatttttgctagtcatgcatctctttccctctcctgcatccctaactattgatagaagtcatctggggttttacctcaagcttaatagccttttttagcttctagtcgagtcttatgctcttcgaaggtttcactatctcctgcttttggtaatttcctataccactctttttttgctttaataactctttgcacctcctcattccacaatatgattcttctatttgagatctgagacttgtacacatacctaaatcttcacttttatgcaacttgtcatttttccactgaatatatgcatccctgctccctccaattgtttgtccttagtgtcactaccaaattcttgataatgcaactcttctcctcccttgctccactcttttgcttcagatcagtaggagttcttctagtataaccttgtagtttttacatgtaatgatgctttctagaagtatgaactctgttttgctatggttatctcttaccttatgttatcaagtgcgattctctttttctaaagtatgtatcagttaaactactgcataagttaagaaactctaaaatagtcttcactcctaaaacctatctcctgcagttgaagttgtctctgtctaccaacatgtctattcagatcgtcttcagtaaaatatgttggtcatttgggatccttggaccaaagtatccatatttctccgcggaatattggcactaatgatgttgaaagttttctttctccgctgactagacaatccgtcactatttcttatttactcctataactttatccttaggcactggttgtacaacgatcccggttttcattcctgttcttatctatttcatagtaatacattttataacttgtgtcgtaactctagcactttcttgattcacctactctcttgtagacacacctcatctggcctaaaagaaaggaaaaaggtagatttagtacatcatcctttgggacattgtagaggatagaaatcagagatgttttaaggagttcatacttcatagtcctactcaaaatttgaagttcaaatcttagtatctcagtctctggcattttggtgtaggtttgaatttgtaaattatgcagcagatgattagatgaagtacgtagagcgatgcaactacttatatattgtaatttccactttgtcgttcttgattcttcactgataacaagtgattaccttgtcgcaagaaaaaaaattcaatatttgagaaaaataagagacacattctagagaagatcaaatactagagatctgatgctaagattttggtctcatatatgattgtgtgtttattctttttatctgtaacaatcaaaatgctttatttccctatgaaacaaaattgaagttctcttattttttagaaactttttatgctacgaagctactatggttttcatgaaatttattcgtgccttttttaggttctgatatatctttttcccaggataaagctgattccctatttttcttttgccccttttcacttatcttatgttgcgcttggagaactcacaacttttgcagtctcaaatatacttgtatgtgattgtctggacaggattgaaagattggaaatatttgacgaatttgaagagtggtatatgatgcaggtaagtttttatcaccccttctgcatttgactgcaaaaattattcagtgtgtttgcttggaatggtgtgaccttatccataccactgtgaaagtagagcactttgttccagattcgtagatgggttggctatctttcaccttgcaaaacgaatttctggcctgtaaattttgtatctggcatcatattattctacaatctgtaactgctggataattaacctgtaagatgtcattatacaacttggaagttggaaacgatgagaaagtatatccaagttaaaaattacaaaatgcaggcttctttactttggtcaattggcgtattcagacttgccttttcttgaccttatgttttggaggagcaagatgctgctctttcttttattttttacatacgaatttattttagggtccattgatgctttacctatacatgtcagctgttttagtcgaaagacaacctttctgtatgatgttatttgaatgatgatgttagtgatgtagtatctgaatcttcctctgccaatcaaaataagtcattgatgtagtagaaaagaaaaaaatctaagttaggtgtactgtttcttatgtcatgtgctcacatgccttttgatcaggggactttggctgtttaaaagttcttaatctgttacaacaatacatttgcattatgtaacttgggatcttgtaaactattagtgcttaatgtcaacagaatttgggaatgaatacataaaatttgatactcccctcatcatgtagaccctgttagactaagtggaatttaaaaatgaagaagaaaaacaaattgaaatagaatatttcagtatactggattaatttacagaactgctaaagtttcggaaaatggattgtttgatgaaaacgtcttgtaccaaagctaaaggcaatataaagtagtaatatggtggtaacttgaaatctacgatctggcaaactttcagcatctaggagaagaggtgaagtaaattgaaatggacgaaaaagatagtaagacttgaggaagtatttgaaagacccaaaaagaaaaaataccagaggggaaataattacaccaaatggctgcagtttctttaagtgacagccgaggtagatttaatataatcttgcttttgaatcttgtcacatctttcaaatattgcttctactggaaattcaaattagatttactaatgtgtgaaactttatttcggtcaggatgatattcttaagcttcaaatatatccatgatatgactatgtcacccccccccccccaaaaaaaaaaaaaaaaaagatccatgagatgaagatatttatcatgtaagaagaccctacatagtgaaggttgaaaactttatgaagatgatgatcaggtatcagaacctaagagaaaagttgactcatagcaataagtggtacgtttctcaagcattgatgtgtgatacagttcacattaacaaagtacgcaaagtttaatttgtggtccaaattgctagtccatcctttgccagtttatgctcgaaggggaagttcatgttagtctattcagtatttttcttcttgcaactgtgtctgttaatgaaagattgcatagttatacgtctgtgatccagtttgctggtccatctcttttcagatcatgctcggggagaaagcttgttttatttcactactttatttatcttgtataatgttcctcttcattcagaaattaatctattttcttctgaaatcccaattgcaggagcactattgtgttacatatgcaatcaacgatgctatggtatgcttatatctcttctccattaaactatctaattcattctagacttccaggagtacttcactaatcgtgtccatctttaatgtgatctatattacagtgtctgttcaaggaatttggtttccccaatacacagcctatgacagacacctccattgcaacatccacatgaaaatagaacctgatcttgactatcattttccttcatctctggtggtaaccagaatatgaatggaggcttgttcctagttgtcaacttggcagggccagaaggtttttcatgtactgaaaaggtctctaccagttctgggtcctagttaggtgtattaagggatggtcatttgtgtgaatgcatctatacatatatttgtttgacgtgaaggggaagatcctctgcagatactttttatttattttgttttatgttggactgaaatgagcttgaatggactgacatgggccgtaagagttcatatagcctatcctaacttggtttggattgagggtgttagtgtatgaagggggagatcctctttgctagctgtttggcaaagaaaaacgtggtagggccctttcagaacggaattgtgttgttttgcccttgttgagtggggaaacacttgcatggttgtctcctcttttttattagatactcttttctctttctttacttatctactatttgcatcatccttttgttcttttgtatttaattgactattgtaccaccgaattggtagatacgaaaaatcaatgtgcttcatcataacaacttttgtacctcaaataggattcatagctgtggaaaataaaagtatttcttttttgtgatcctgcattttttaggttatcatatatgtgcagattgggttcgcggactctatacatctggcacaactgacgtttatgaaaaacacaattaagtaaaaatagcacgtactagtcatttttcgaactggtcattcaaaaatagctagcatttgcaaagttattgaaaaatagtcactattttgctgcactagggaccagttcagcataatataatggagatcggtgcacctgtgtatgaacttctaacatattatactggaactctaacacgcagaaagttccagcataatatactggagatttgagcacctgtgtatgaacttccagcatattatgctggaactccattaaaatatgctggagttccattatacttatgctggaactccagtatattatgttgaaattgtaacaccccagactatagacaaagtcctatatcggcaaaacacaagagggatgctgggtatataagttaacaagccttagctcctagtgacgtattttaaatccgtgagggcctaggcccagagcggacaatatcactagcgggttgggttgttataggagtatttttcggattttgaacagtgttttcgttcagatttatctttacatgaaaagtggctaaaattcgattacttttgaaattgtgattatttttgaatgaccatttgtaaatctggctatttttgaatttctccccacaattaagggtgtgtacatttacttagtgaactctatccatgcatcatgtaccttacctatagcaaaaataactatttgctctaattaaaatcttgactaagttgtctagtgattgcaattttatcctccctccttattcaagagaaagatttaggaaaaagaaagggtagtactgggcggaatccttgggagaacttttagcagtgagatgcctcactatattttgtgtaaaaatttacagaccatgtttacaccaatttaatgaatatatgagatgtatctttatatgtacctgttatcacaaaattatctataattaatgaatgatttattttaccttacttttatagttaaccatagtaaaccctgagtataagtaggtttttttatatgtttggataaagcaagccatagtcatcaatgcattgaaatatggatggaggggatcaggggccaaagcaagaaaaagtggttgcaccaagtggaggttggaataatgtaatcctgacaaatagatttaagagaagcgggtgggggccaagggggaaaaaaagggtccccctttgtgttcacctttttaggagggaatagtattatggttccatgattttctatggattgcagccctatcagtgtctcacactgtctttgctcgtacttatttctagtttctaggctctattctgttcctgctaagtgctaaaaaatccatttttaaggatataattataataatcttgcttgcagctttaagagacgtccttgtttgcttcttagctaaggctgcatgatgaaaccttggaggcttcttctgtaatttcctgttcctaaacagttttaagaccgttagaaaatgtatttataaagtaaaaagtgtttttttcaaaagtacttttggtgagaagcagtttgtgtttgactaattagtttgaaaagtacttctgagcagcaattagtatttgaccaagctttaaaaaactgcttctaagtgtattcttctcaaaagtgcttctcaaaaaagtgtttttggagagaaactattttttttttgcttctccaaaactgcttctgtttctcctcaaaaacactttttttccttccaaaagcttggccaaacacctcaaattgaggccaaaagtggttttggcaaaaaaaaagcacttttgaccaaaaataagcttggccaaacaggctattaatctgacggccgctcgactggaagttaatttagacccttccgctgcacactttctttacccaaatagccggcctagttaactgttttaccttttctagcagtatgtataaattattatacatatatcatatatttgtcggctatttttagtttaagtggttagataatcggctatttagaatacttcttctaatctaagatcgattaaaatatgggttctaaattggaaagtacttccgtctttcttttgtccagtatgtatcgtatgatatacaagtcaaattaacattcttaaatgatgctcccttagcttcaaacgaatgacggaagcttaattggatacacgtatatgttttgtttgctctttccttttccaacttccccttctccctcgcgtcttccctccgttgttatgttattgcttcctttatctagtgtcgtgacgagaggtggaggcaggattttaagtttgtgggtttgaggttctaatctttttaagttattgagttctaaattaataatttatatacgtttaataaaatttttaagacaaatacattatttgaaccaaagttactggattctgccgaaaccgtaacaaatgttgttgctcagcctcttgccatgatgcatttgctcccttagtggtcaacgattgcagttagttgcagttggacagatagtgatatgtagtatcatgtatgatatgatcacacatactagcaccttcgttagtacgtgacaagttgatattgatgagacttattatgatgtcgtgattaagataatgttctcgccatatgctgtttatgtaaagaatcctgaaacaatgctctttgctagtttgaactgctgttagtactctactcctccaattttgataattttctgaagagcttgcgtggcgcttacaagtgaaattgctaaaaaatagtggcaatgtgctgtggaaatatcaatttagtcacctttcttttacgatttcttctgcttttttttcttttctccctttgtgtggtgcctaaaaagcatctgaattttttggaatacataagaaaaggaaaaagagaaaaagagaagcatgtgagatgatacgatgtcattgtctagtgaagactgttggagaagagactggttttttttttaaaagaaaaaaaaaagaataagaagaatccctttcactattttcaaacttttcaccgctctctccctttccccgatgtctttttcctctttaaataatattcacacttcaatagatcaataactgttttattctctcttcttttgatctcttgtttccattttttccccattaatattttaaaaagttatctgccattaacataaagttttggttaagaactaatcgcaaaaacaaagatttacctttttactctaatatttttggaaatagttctattaacaattgccaaaaatcaaattaaaatgacataaggctgacatgtcgaggactttgtttgggttgattttaaattttagaaaatatggcaatgtttagtttagttccatatttaagaaaaaatggaaccaaccaaccaactatatatatgtatattaaattaatttataaattcgtaggaacataaagttggataaagatattcatggtgcttgagttttttactcttatatggagttatttaggagaataatgataggtaagactgaaaacatatatggatgtaagcttttttgtttgaattatgaaaatgattaattgtcatatcttccaatgaaatttctctcacatagatatttcaataaataatagatcaatcaatttgttagattcttgctaaacgaatacgaacatatgagatggattgaatacattaaatttgcgctttgtgtggaaaaaaatgagactattactgaaatggtcactcaactattccaaagtatcttctaaagtcacttttattttatttgtaacaacaaagtcactgaactatgcctattacactcaaaaggtcacccaactagatttttcaaattttggattgtcaaatacctattttactctctaaattataaatatttatcttttttgtttattttttaaactttttagtaacaacaaaaattcaaaatttatttacataattcagaataaaagaaaataaaaattgaaaaaaatatatatttcatacacgtaatataaaataattacttaaataaatgtatttttatagtatacattatatattcttaacaattgtggtaaattatattattatgtttctaccacctttcctacgacacaaagttatgtcaccgaaaagtagggaggctatctgtatagggtaaaatatgctatgttaagtcgtgcatggaaaatatataatataattgagcatagtttaaatatctttattaaaataattatttttatattacgtgcatgaaatatatattttataacctttattttctttcattctgaattgtataaaataatatttaatttttttaatactaaaattattattactaacaaattattctaattaattttttttactatgctcattattttgttattccagtattatatatgcttaaatactttttattttttaaatttataaataatatttattattctataggtaagtccataatgtaaattaaaaagggaaaaattataatattaaaagtttaaaaaaataaaaataaaataaatatttataatttagagggtaaaataggtatttggctatccaaaatttgaaaaatttaattgagtgaccttagtgcaatagacatagtttagtgactttgttgttataaaccaaaaaaaatgactttaggagataatttcggatagttgagtgactatttgagtgatcaacaaaattagattaaaaaattgacttttttgttttgatttgatttgtatgtttaataaatcaataataatttgttttttttttagataaaaatcgaactaaataaaccatgaataccctagtattaaatttgtaagatcgtgattttatatttgataaagttgaaaatgaaatgagaaataacaagcatgggtaatgtaatttgttgtgagttttcatggcgcacttccccttaaaacactaaaatgttatctttttgaccaaataaatgtgagaatatgctcttgtgctctctttttggaaaagagaaataaagtttcgaaacctcccaaccaatactctaaaaagaagtttccttttcttgccctaattagagtttaaccctaccctaaccaaaatctcccttttcacacttaaaaagaaaaaagttgaatgtctcgataccattcctagtagccaatcacattggacattataattgtttttttacactttgccaaaatgatcaatcaacaatccttaggttttaatcttttgcattttgtcttaatgaatgattgcaatttaataatgtcccttctcccgataaattatcattttgcccctcattttagctatccttcctatttaaccgttatctagtcattttttgatgaggcgaaagcttagtgcatcggactgccatttaggttcacgcatcagcatcaatcaaatttcatcgcaccttttaaacgctcataaaaatataataagcaaatgaatacggtctttcgacacgtgcaagggagtcttatttgtgaaagttgcaataatgtccatctaatatacttacccaagttgttgagtgaaatagaaggattttgttcagcattgaagcgaaaactcattgaaaacgactatcataaattacggaataagctcgcaagttaattgaattggttaggtgagtgatttctcacataacagagattttatgcatcaacaacctcctcattaagagctcgtacaacgggcttgtctagttcggttcatatcttttatgtgatatgcgaactattgcgcaataaacgaattactcgctatgcaccataaagataatgactgcgaattttccggatttttttccccatatatcacggaccaaaaataagagacaatgggtagaataggaatataatcccaactttttccaatagatttgagaagaaacatggcaatttactctgcctatcggcattatgagcggtattattgatgtctttagctactaatttggttggtgatgtgtctttcttcaagcgtttccttttaattacctatatagataagtcaacacaagtttcgagattgtccttgcatattttttggaaaaccttagatgagatgataccagtaaacattctgggtttttacgttattattatcagacacggactaataacctgcttaagtacttactaaatacaacaacaaaccacgagtggctacccagtttaattttacaagtgaggtttaaagacggtaatacatacacaaacattactcctacctttaagaaaacaaatatactgtttctgataaactatcaacttaaaaaaggtaaaagaaagggcaataacaagcacaccaatcaaaaaactaaaacaaaaatataaattaagtactgcaattaaaaatccgcaacaaaaacaataagaagtaataacaaaagttgagaaatacacaaataacattaagtcctgtactaaagctgctaatagtatttaaataagttatcaaaagtttgattcgcaaaaaagaagagtggcaaacattaaagaaaaaaaattacgaaattaattaatatagtagaattaagataagaatcaaccaaaaaaaaaacattctaaaatatggcaattgaaaatctcaattctgtattgaatgacagtgggctctatgcctcaatctaagatccaaagcagctacctcctactagtcctttaccttccaccacccctaacccctaggccctaccctactctttcttgttgctttttgccagctgccacccatatccatgcaaaatacaaaaagcagcctttttctgttctaacaacacttttattaataaatcagtaaaaattatactattttaatccttttaaggaaattcatctcctttttccgaaagcgacccatgtatattaaacattccaacacaatcaaatttaattgaaaaacttggagtccgtttggtcatgagatttttttttttactttttccaatgtttggccataaaatttttaatttttgtttgaagatgaattgtagaattttttaaaaatttaaaaacttcaaaaaactattttcaaaattctcacttacatcaatcacaaaatttaaaaacaatccaaaaatatattgatgttgaaacataactctaatttttcaaatatcattttcacttgaattttttttttcaatttcattcggaattgtacaattcttatgtccaaacgcccgcttactctcttttattaaaaaaagattctcggagtaaagagaattttaatacatctataattaagactacaaaattcttaactacttataaatatttatttagaagtgcataagattatttagaacttatagtttttgtaaaaattattgtggaaaaatgattttttttaaatttcttaaatggttaatcgtgattttcttttggaatagagtagtaaaatagcttcaaaacttttaaattctgaaaaagaaatagaaaaacagagccagtcatttttaaagtggaagactttttgagtgagtggagtaggaaagtgtaagagtaaagtgtagtagtcagtcagtgtgtgtctatgtactgtgtgtctgtgtgtaaaaaaactctctcaatggcacttcttcttcaccttctccgcccatttccgtcgctccttctttaactccacaatacacagcgctgtcccttctgccaccatcaccaccgtaagcggcggagaccgcacctcatttatttacagatgggttgcacggcgtcgaagctagataacgaggacactgtccggaggtgtaaagaacgccggcgattgatgaaagaagctgtttacgctcgtcatcatttagcttcagctcattccgattactgccgttcactccgtatcaccggttctgctctttccaccttcgccgccggtgaacctctttccgtttccgatcatacccccgccgtcctcctccgtacaccctctactactaccaccaccattaaaaccccagctccaccacctcctgttcgtatcccatccccctcaccttcactccacccaccaccaccgccgccggcattttctccgtctccgtcaccgacgatagcttcatcaaagctacctcacatactttcttcctcctctgtttcctcccaccacaaccaccaccaccgtcagcctcagccgttacaacaacggaaaaaacccgtaaaacttccacacattctttcgggatcaagcttgagttcatacaatgaggaggattatacgtacgatgcgaaagcgaattcgacgtattcgagtactccttcacaaacttcctctgtttggaactgggaaaacttttaccctccttcccctcctagctcagattactttgaacgcctccgtaaagtggacacaatggatgctgacgatgagcatgatgatgataaagcttcaaactttacatcttattcacactactctcagcatcagcatcctactactgaccaatcatcacttagtgggaaatcgcacaagcaaaagtttgattttttcgatagtcatagtgttgatgatgagaagttgactaatgggtctgttaggaatcacaaaatggtgggtgaaaacaagagaggtcaccatttgaataataatagcaagtgggaggatagtgaagctgagagagaagaggtacagtgcagtgaatgggaccatgatcattatagtactacgagttcatcttctgatgatgatgaagaggaagaaaaggatgagataagatctgggtttgggccaacccggtctaattttgggtcaatgaagagtgaggaagcttctaagattggtgatgtcaatttgaggatgaagagttattcagggaggaaatcggataaggtatcgtcggaggatggagggtcgtcttcgatgagttgggggaatgggaataatgggaaagtggtggaggagatggtatctgataataggagtatagtggtgaggcacaaggatctagctgagattgttgctgccattagggactactttgataaagctgcttctgctggtgaccaggtctctgagatgttggagactggccgagctcagcttgatcgcagctttaagcagttaaagagtgagtctttttggattcttgatttatgtggaatgcataatgatttttttattttccatgccttttgatgatttgatcttggcatagcaattagatggtattgtaattttctggaattgcatttgcaagctcacccatctgagcttcggttagccagtttagagtctggataaaggaggggaggggtgtggtaggttagtgtttggggtaaaatttgtcaaattatgatgaatccagatgattcataccattggctacaactagtttgggattgagattagttgattgacattgatttatctttcccctgagatccagttgggaaaattttgttgaaaattttggattcattgtttggaatttaattattgttttttttgttcattgcagaaacagtgtatcattccagtggagtatttagtaccataagctccacttggtcttcaaaacctccactggccgtcaagtatcgttttgaacctagttccattgatgaaccaggttcccaaaagagtctttgttccaccttggagcgactcttggcatgggaaaagaaactatatcaggaagtgaaggtgctcttctcaatcccgccttagtcttcactgcattcttttcactttctcggtgttccttaccaattggtcttttatgaatcatgatctcagttggttaactggttgtctgcaaagatagaaaagctgtagtgaaatctactctgattcaatcaagaataggttaaaatatactcaataatcgtaattgggtatttgtactttagtcgagtgacagaagccgggttttcggctgggaatcatatgcatgttattgtagtcagaggtgtcaaaattggacggatcatgcttatcatccaaacttcttcagattattcagcttgtgtaatctaacttgtttgcactccatttagtcaataatggcgtaatgactagagtatccaaggtaactgcatgacttgacaaggacaacttggagctattatgagatatattaatttagatgcaggtggccctgccttgtactaagttagctctaaattgatatggacttcattttgaaagacttactccttcttccttttgtggttattactgtggaaaagagtagtataagtagtgtgtttgagcagttttaaaataccttcaactccttatagacaggaaactgcttcttgacatgatctaaaattattcatggatatatgcgtgtctctgcatatatgtaagtacatcttaagtaagtacatcaatgtgttctttttatttggttattttgatgagactgagtacaaaaggaactattcaaaagaatagaaaaagacaaggaaaaaaagtaggaaaaaggaagaggaaaaggtttgccaacttgagcaactgcttctttgcacgtgtctttagccctacacatttgttaatccaagtactgtaaatgcaggcaagggaaggagttaaaattgagcatgaaaagaagttggcaacattacagagtcaagaatgcagaggtgatgaggaagccaagttggacaaaaccaaggcctcaataaagaggttgcagtcgctgatggtggtcacatcgcaggctgtttcgactacgtcctctgccattattggtctaagagactctgaccttgtcccacagcttgttgaactttgtcatgggtaagtccttatgtttggtgcatacttgatttggaatttattgactgcaaatcttattcagattatttgctgtcggacacatgcatgaattatgggttcaaatgagatatggttagtacttacgtcgcgatactgctctgaagcaacatcaactacccttaagagattaaagaagtttggttacatccttaccgaaatttcttccaagctttattttagaacctaaatcaccgagccatctcaagacttatttccttaaaattgaattgataacctgaacttctcctacctaaaattggcatcttctatagtcatgctctcaaagcatgttggtgttgctactggcctgtttcagtgggtagttggaaaattatttatcttttaatgtgccttgcttttgtcttcctgagcccctaagcttgtccacgttgcatctttctatagtctaacagcctctccaggacaggttgtggtcatgatggaaccactatttctggaaattgggaacgtctactgtgctttgacatgtgtaattgatggctaaatatggtggtgcttcttaggctgatcattattgttgccttgataagcttaatctaaaaagaaaaaagtagtgttcttcatggtagttacaactgagccaggtcaagtcaattacagtactaagctaaagtgttatggtcttggatttgaaggctaaagactcagtttctttgacccctggaattttgacaattactataatgattgctgtggacatgtgtgctcttctactaggaagaaagttttaaaagattgtctatgtttatgttttgaacttgaatggcagcttatgataaagtgtttactgttttctaagttttgcccctgactagtcctcaactgatattggtataaacgggtgcagattcatgtacatgtggagatccatgaaccagttccatgaagttcagaatgacattgtgcagcaggtgcgaggtctcatcaatagagcaactaaaggtctatcaacgtctgacctacacaggcaggcgacacgtgatcttgagtctgctgtatctgcatggcactcgagtttttgtcgcctcataaaatttcaaagggactttatccgctcccttcatggttggttcaagctcactcttgtatctgtcaatattgagccaactaattgcaacagagaaccttcagattcatttatgttttgcgatgaatggaagctagcccttgaccgtattcctgacactgttgcatcagaagctatcaaaagcttcataaacgttgtccattcgatatttgtgaaacaaacggaggagttgaagatcaaaaaacgaactgaatctgcatcaaaggagcttgagaaaaaggcttcgagtgttaggagcattgagaggaagtattacaactcttactccatggttggcattggacttcctgagatgggacctgataatggtagtgttttagatacacgagaccctcttgctgagaaaaaggctgagcttgcagctagccaacggcgtgtggaagatgagatgctgaagcactccaaggcagtggacgtaaccagagcgatgactctcaacaacattcagacagggttgccgggagttttccaggccatgaccagcttttcttccttgatgacagaggcccttgaggctgtatgcactcattcttatgctattaagtaggaaacaacttgcagaaaactgaatactagtagtactacttttcttttttgggctattttttccgcggttctgggcaaggatggaagagaaagggctggcatttttggtcatgggctcttttcagctagttggctttttcccttgatattttgctatgttgtagatatgtggaattttgcaattttgtacttttatgtagtggtgggaaaaaggaatgttctctgtatagcaaaattatttgcattactgcattgaggtcaacatgttcagcagatgaataaatgtattctcttatgttatgtcaaagtgtaaaaatttgcttcaaccaaacatttcctgctgtactgaatttttcatgacctaaacttcatgctttgttgtactcgttagagtgagcatgtcacaccaagtatagagcattagacaaggttctttagtgctcttatgtgaaccatagcagttcaaatctaagttctggttgaacactgcttgtgaagcagcagttcaaatataatgtgcttttgccacttttctgtagcattgagacagtgacctctatcttttgttccaaaaggaccaaaaatcagggatatagaatgagtttaccaaaagtgtaagtcatagctttattttctccccttgtgggactatttatcttatctttgaagcttgaggaaaggacaagaaaggctggagcttttgctgatttgtgtccccatgagatctttcataattctgctcaatcatgaaataatagacttatgtttgtgagcacgtgatttttgcttcacacgacaatcgctccaaaaaaaaataaaaaaaatatatatataattggccccgctgtacaatttcggatttctgtgcggcaccttgtggatttatttgtgattttggcccattcttatttatttactttattaaaataaaattcaaaaaaatatatatgtgtcctgcgtaattcaaaccgtaattcggtcgttaaatagaaaatcgtgaataggcattttcgtccgtgattttatttggtttgactttaccggttttgaaatattttagtatgtgtgcaaataattgtatttgagtgtgtatttaattttaatttgattttttggcttagctttgttttaaaataaataagaaaagaagaaaaaaaaataaaaaaaaaaataaagaaaagaccccttccggacttgggccaattttaacaaaattggcccaaacaaacagcccaagacccaggcctgcccagcccaggtcacctgatgcccaggacgtccaaacgacgtcgtttgagtcgtgcctgatctgggccgttgatctcagagtgatcgacggccaagatcaatccccataacccatcaacaaacccgacccgtttacacccggaccaaacccaaaccctcaacatttgaaacgacaccgtttcacttaagaccatcagatccaaaccgtagatctagattgatctaacggttgagatcgacccacccactaactatataagcccaaatccttaccctaccccccctatccaataccccggcctcgtcgtcttcacccaaacccatccccttcaaaccctagccgcccctgcacactttcaccagaaacccagcggcctgaacgccggtgaccttccccttaacaccctagaacccccttgccatcctgaacatggatctgctaaccatgtagttcgaatcatcccctaggtcctcgaatcttcatttgaagattcgagttaaaactcggcttacaccaaccaaccccagcttcacaccagacactccccagacccccctcgtgaccaaaccatacttggtttggtccgaatctaaccagggaaacatgaatcccggatctgagttttggaactttgtagttcctcgtcactagttcatacccgttcgagccaaaaaaattaaggtccaagggaccttaatcgaagtgtttctcatctgagaaacacttcgattaaagtccgttcagccttaagaaagtctgtccaagtccggttcaaggtttccgatttttcaagatttgaggtgagtctgccttcttcccttatttgtttggtccatgtgagggattagatgtctgttcatgttttgtgtcaatttgtgttttgaatttttaccaacttccgtttgtccaccttgtttgaaccactatgtttgtttgaacccctcatattctgataagacatatgtattgggttgtattccaaatttgtactgattatttgactcctcgagggtatttctgtttagtcagtataattcaaaccatgtgtcccatactttaaatgtctgatttttggcttcgattgtgtatgttaatgctaatatagtcgagtcgacatatgtcgtcaattagtttcagctacccgaacaaagttaaatcaatttgcttctgatgaacatttgcctgaaacaattaagaaccaagtccagttacttatagctgttaatatgatttcagaaacctaaggcttggtctgttaattgaaatctgagttgatggcatgtgcacttgtgcacagcatgtgcattgtgcacagcctgtttccttcataaaaggggcttttaaatttaaaatgtgttgacagcatatgctgtcagatagattctactgcccataccttgctttaagtttaaaaaaagtattaaaccttttaaaagctaaatctgccagggaatgttgatggaggttaatacttaaataactaatgggaatctgaaatggaaatgcacatgggaggggcatggtgatattctgaaaacaggctgttaaaaggttgagtttgagacttataaaaggggggataggaggaccatctgaggataaagatacacagagagagcatagatagaggggagttgaagttctggagatacagacagaattagagacaggattgagagatagaaatacatacacacacacacaaaaggatagacattgaaccttaagagctgaataggaaaaacacaaacagagatagagagaggttaagggatagaagctatacaaccaacaatcagaaaccttcttcctcctattgttattgggttttcagttgtttcaatttgttcaagccaattttgatcctttgaaatctcagttgtgtctattagttgagtgctttcattggtctactactatctggagtttctgattctactccactgggtgttgctgttatttggctattgctttctattggctatatttgcatctctgcactcgagctgggttcttgctgtattgctttgtctgctgctatttctgccctgctgctactgatagtgctgtgattgctgctgcattttgttgtcattatattctgctgactccccctttccttcaattgtcaaatatttccaggtacacaacctctgaaactttgtattgttgaaagtttgaagttgaaataaagaaaagaacagctgttcatgttataacattggtgttaaaaataggtcgaatgttagtgggattgtattttactgcaaactgcaaacactttgtataaaactagcatacattctgctgagatggactgttagatagcgctgttcaatagcaataacaatatgatagacagcatgtttgatttgggatacgttcagttcagtataatactgtttggtttagttacgactgtataacatagagtcagggcaaacacttgtatgtatttctgcctagaccactgaatcgacaaatctgtggtattaggtctgggatagatgtatcccaaacaaactctcatgcagtcatattaaaagtctggctatgaatgccattttcgcttgtcagtttatttgttccaatgccggtttgatatcaggtttcggtacagattcttcgtttcgaaatgatgtaatgattgttgagaaaaactaataatcatttttgagttcaattagtagtaatttttcctaataatacatccgatttctttatcaatttcaaataggttagagtgttaagaatagaacttggaggtcgttaaaacataactcaatatatgttgttagtttgtttgcaatctcacttagcgaattaataagcatattcacttgttgaagacaaagaatgccgtagctttcacctcatgaacaatcaatcaggtaatcaaacaagtttaggttcggcaaacataataaggattcagtccgtatttgtctaaaccagcaaaatacggcatcatccttccctttaaagataaatgtagtaaaaatgtagtccttgtagggtacccttctaaaataatgagacgagcctcgccgaatcaaaggcaaattgcggggccctcaataattggtcataataaatacttagaatttgggacgggctgtttagtgaattccactcccctccccgaagacaataacgcgttagattctttaggcgcgacttaatcaaattacattcctaaattcgggtgcgcatttatgtgacccaatttcaaatctcaatggagtcgaaatgtgttaacaattacgggtgcattgattgtgatgtggttcgagatacgttttcacgacgttgcaattctataaaaataaatgataataataaaagcggttaaaacttaataaaagcacataagtcacaacatgtatttaaatcagatatttagccattataacaatttaagcgaccgtgctagaaccacgggattcgagggtgcttaacaccttccctcgggtcaacagaattccttacttagaatttctggttcgcagacttcatttggaaaagtcgaaaatttcctcgatttgggattcaagataaaccggtgacttgggacaccaaaagccaaacctttcccaagtggcgactctgaattaaataaataatcccatttcgaatattgtcacttaaattggaaaaactccacccgcgcatttctaacccttcggggcgggcgcgcaaaaaggaggtgtgacagctctggcgactccgctggggattaaaaaacccagaaccactggttcagggttcaagaattcgagcttagagtaattgttatatctggcttattatctgatctttattacatgttttgcataaaagtgctaaatgttgtcttttaccgcttctgatattatctgaactgtatataaactgtgccgaaacccttcttttcttacctccggggagaagctcgctggtcgagactccctattctgttagtgtcaatacctaaaataagaaagaggacgaacaagttacaaagccggacgatctcgcgggtccccggtacgtagccccctcctcgactcgagttgtccgctcgggtacacagtctagaacaaataccaaggtttaaacctagtataacgaaacttcatgccggatccctagtaggaacgcttatttgcatcacattgcatttgacttaggggactcaacacaggggttgggtccgtctaggacatgcaacctgaaatggaaaagaccatcatgctgcattcctatctgtgttgtgcatttatttgcttcgatttcgcatgtcgaccggttcctaaaaaaaaaaaagaaaggaaaatagcagcgtaggggagataattacttaattttggaaaataaaaccaatgtccaagaagtgtcaaaaccttgccgaaattttcctaaaaaaaaaaactgtcttgtttattgagagtcattaaaaaaaatatatatataaaattttcttttatcactttcaaagataaaaaaagggggtatttattttaagagtaaaaaaaaaagaaaaaaaatcgaaaattcataattcaaaaaaatgagttgtttctttcgtaataccccttttatgaattcagactaatagtccaaattttccttaaaaaaatataataataatatataaaaaaaaaatataaatatatagtttctttaatctttatctcttttcaaaaaaaaatgcaaaaaaaaatacgcattcctgatttctaggtttattcgattttttttcctatgttacgacaccccgaactacgccggtttgattctcaccggatgtgagatacgtaggcaaccctcgtcgggttcaacccccattttgctaacatagccaaaatcaaaaaatatatgtttcaaatttttaaagagtcataaataagtcaggggatgctgttttgacatgaatagccgaatgttcccgaaaagggacgccggaaggctgactttgcataaatagccacttttgggttttccttagcatgtttagacccacacagccttaaaatcttcttccccggagtgcttaaaggccgtgttcaaagcttggtcccctctgtaaaatattttgagtcagtcatttttgttaaaatcaccttaataaatgtgcaggatgagcacgatgcaaaatgaacatctttcaataatgaccaaaatccctatcaagttacggctatggtggaatgatctaggtgttgaagggcaaaatgaggttaagaaaaatctgaaaggtcttgtgggtctgttggaaatccagcctcggggagatatcataagagctttggttacctattgggacccggcgcacaatgttttccatttctctgattttgagctcaccccaactttagaagaaatggccggatacatcgggaatactgaacttccgctgagggaaaaatacttggtcgccccaagagtcgtcacggtacatcggttcctggattcattgaaaatacctagaacagtccacaacccggatctagcagccggattctgtactccatgcttcatatatgatagatacggtcacgaggggggattcaataatccaatcaacaaactgtgcagcaaaggagttcttcagaagtgggacgagcacagacgggtggcgttcatgataacgtttctgggtcttctggtatttcccaggaaagatggaaacattgatttgaagatatcgggggtcgtcagcactttactcacgcaaagtgacagtactctcgcgcctatggtggtatccgacatctttcgagctctcacagcttgtaaagctgggggaaatttcttcgaaggttgtaacttgctcctgcagatgtggatgatcgagcacctttgccatcattccgagattttgagccatggatcaccggaaaagacccgcatagaagaatcttacgcgagagccaaagagatcagtttgcccgaaggagtcctggcttggaccttgttctttcaagctcttactgccagccaaatacaatggaagttgggatggttgcccgttgatgaggtcttatatatgtcagcggctaaaactcatttcttgctgatggggcttaagagcattcaaccttacgcacccggccgagttttaagacagttcggaaaatgccagacagtacctcatgaggaagatctaagcactcaagcaattgagataagtcctaacgggcagttcccagaagcaaagattcgccaaatctggaatgagggtcaatatttgaaatcagatacttgcgtgcgggatcaagccaaaggagaaacggcgccaggttaccttgcatggtacagaagggaactcgagcatgaaaggccaactaagagaccccacatccggaatttcaccgaatcatcacaaaagcagtgggattggttagcgaaagaaagaggctattgcaccgaaatcagcaggttaaagcaacaagtggaaaaattgaaatatgaacacaacgtgcaagttgctatcgatctgggagagcggaacaggttgattcaagaaaatgaaatgctcaaagcccagatcaaacagataaagttggatgcagatagacaaccaaggcgtcgatcggacgagcagctgataaaagggttaaaaggtgaaatcagggaatggcgagatggtttggagaaatctgaaaacatcatagcagagctcaaagcacagtgggatacaagaacggataagcatcgcaggtacctgaatcgattggaaagcgaccatgagaagactgttgctaaaataaagagagagatggctgcacttaagatcaaagcagttaatcaggccaaggatttccaaattgagagcagatactggtatgactcaatagcccagatgaagttggaagtacgacgactgaagcatcagcatgtacaagatgctcaagttttcaagatatgcagcgatcagacaaaacgcctgctcgtggagaagaagcaaaccagagataggatcaaggccattgcccatgccatcaccagacgatgcctacgatgtgagaacatgtccagcgctaccgtcctctcggcagtaatgggttatgtcaagcagactatgcacgagctggagcaacttgagagggatctcacgcctaggaccgcggcaaggccgaacgatgccccgcggaaaccgatttttaaaaccataatgcattcataggtcaaatctgtattttagcatcttctgcctgtttttttcatcaaggtgattttcagtctattttgagtctaggttcattttccaagtttgttttttcttttgcagaatgtagcttgtaatagaacatttcaacaatgaagaggttgattcttttacgtccatttgtgtttttcgaactacgtaatgatctgattcacgtgagtatcgtgatacgtaggcaatcctaatcggatccgatcgcattttattttgctacaaaaaaaaaatataaaagaaaaataaatgaaaataaaataaaaaaaaaaaggaaaaaaaggaaaaataccggaatgacgcatgctctcgtagcagacatatagtaatccacttaactgtataggtgcatcatgccctacgtgagactaactatctgttatttgctgcaaattaaccgtgcgtttgtcattgagcatttccagggtttttgaaaagacggttggtttggtgaaagtctggcctcgcattcatacttcacgagatcaaggagaggtgttcaactacctgttgttaggactagaagcaatactcacacttacttcaccaggtcaaaaggaagtgtggaaatgtcttcggaaattccattgcaaacagtccccgtctctgaggagagctcaatctcagccatcctcacgcctgaatccgcaactgcggaagaaatagaatcctacggctccgcatgttggaaatgctggatgactggaacaatgggaaagagccgccaagtgtcgtccccggattccctgaattattctccaggtcaggtgggacttctaatgtccccgtaaattaccctgctaccccattcgggtacccagccaactccgctctctccgcaggatcaccttctgagcctcatccccgaatgtcggccactgatgcaagcatgaacatctttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaaacatcaagaagattttgaggaaaacaatacaaaattcccgacagtggcatgagcagttgccttttgcattattggggtatcgcactacggtgcgcacatcggtgggagcgaccccttatcttttggtttacggaaccgaggccgtaataccggcagaggtagagattccttcacttcgaatcattgtcgaagcagaaatcgaggacagcgagtgggttaagactcgactggagcaattgacgttgattgatgaaaagcggatggctgcagtttgtcatggacagttataccagcgaaggatggcccgcgcctacaacaagaaagtccgcccccggaatttcgaagtagggcaattggtactgaggcgtattctgccgcatcatgaagaagcaaaaggaaagtttgccccaaattggaaaggcccatacatcgtaaggaaaatattgccaagaggagcattgtatttaggtgatatcggaggaaatgaccctgacacagcggtgaatgcagatgcagtcaagaggtactacgtctagatcatactccaagtggtcctgacacgttgaaaagggcgaaggtgtttattccccactactccccaaacactacccaattctcgctaccaccttttgagccgttaaaaaaaaaaacaaaacaaaacattgattgaggcctgaactacgtttgacttgattccgaaaggatacgtaggcagcctctccctgaggttcagtcacaccaacaacaaaatcccattcaccctgaaattgaaaaccggggcatgtcggacacttgagaagtttagtatcagctacctctctttaccaggtacaagccttcaagtcaattaccaaagatagtgggaaaccgataagcatcacaaatggaaaccggcacaccccgagttgagagaaataaaatgagagagtctcggcggtgaaaaccttcgggcaccacgaggcgacgggagtagagaaaccaaaatgagagagcttgtttagtaaaaactcgcaaagagtgctatcaagcgatgacaggaagaggaatgagagaggtcagccagtgaaaacccgcaaagggcgctgttggccgaaaaggaatgacgccaccccaagaaggtctcggcaaagttccaccagttttggaatcacagatctgttctggtttaggaaaacgcaagttcatggaaggtcgaacgtccagtccaaagagcatgtcatgtcatttaaagccagcgttatcttcctcagataagtctttctcgtcccgaaaagggtattccttttctgatttgttttcccctgctttgtttcttttcgaatccctttttgcattttaacccagagttcaggacgcaccggaaagagtaggtggcatggtttgtttgcacggaatcccgtctcatgaaggaaagcacctcatctcgttgatatgattacccaagcatgatggatcatgacgtttgatggtgtgccggagtaaaggaaaaagagagaaatcttgaaatcttccccagcaagtccaccttcggacaaatccccacagagtctccccctgtacaaatcccaacagagtcttgtacaatctcccacagaatctcctcaatataaaaaaaaaaaaaaagaagaaaaaaaaaaaaaaagaaagaaaatggaatctcctcagcacatcccagcaagtccttttgtaaatattccccaacaagcttaccccaacaaatcctagaaatcccactttgaaataaatccccagcatgcccattgtacaaaattccccacaaagaatcgactttgtaaatattccccacaaagcttcccttttgtacaaatccccacaaaatacctccaataaaatccccgttgagaacctccaagcaaaacgggacacaaaaaaaagagagccttacgaggcaaatcatcacagaatctggaaatacaagcctgagcggtctaaagggtttcggcatatgaatcaaatcaatggcgggacttcacaacagaaatgaagacgcaacaaagcaaccgggaacgatcgaggtcaccaaaccgaccgtcatttccgaactaacaattgtcctttgctgaaaagttgaaacaggtatgatccaagacaaccgtgcaaggagcaggtgtcgcccaaagaagaaggtacatgggtacaagaaatattttggcaataaggaattcactcgaaaggtaagtttccacgaaactcccttgtatcttatactaaaacaagaaagttcaaaaaaaaaaaaaaaaaaaaagaggtcgtttagtattctcgaacttttccttttagccagcattagagttttaaactctaaactgagcttttccatgcaatcagcattagggttttaaaccctaaactgaattttcctttagtcagcattagggttttaaaccctaaactgaactttttccttttagccagcattagggttttaaactctaaactgagcttttccccatgcaatcagcattagggttttaaaccctaaactgaattttcctttagtcagcattagggttttaaaccctaaactgaacttttccttttagccagcattagagttttaaactctaaactgagcttttccatgcaatcagcattagggttttaaaccctaaactgaattctcctttagtcagcattagggttttaaaccctaaactgaacttttccttttagtcggcattagagttttaaactctaaactgagcttttccatgcaatcagcattagagttttaaactctaaactgagcttttccatgcaatcagcattagggttttaaaccctaaactgaattttccttttagtcagcattagggttttaaaccctaaactgagctttttccttttcagccagcattagagttctaaactctaaactgagcttttccagccaatcagcattagggttttaaaccctaaactgaattttccttttagtcagcattagggttttaaacccctaaactgaattttttttttccttttagtcagcattagggttttaaaccctaaactgaattcttcctttgtttggcgtaagggttttaaaccctacactgaacctttccccagctagtcgatattagggctccaaccctgaactgagcacgcatatcctctttcatcaattttatgaacttcctggtgaataagtaacgaaattttcctagtgaaactggggcagaaaatttcgtttgtttgtttcttttctcccgcaggtctgacctcgagccacatggatcgaaatgacccacgagataaatcccagttcggaatcaaagaagaaaaagacaaaaaaagagatatcccgagatatcagagtaaagggaaagcaaatcgactccaacatttgactaaggtcctgacctctgccggtcacattttattcggtatcccggagattaaaaaaacaagtcgccgcaactcgcaagcatcaagattcagatcagagtctacaagcagaatcagctaagacccaagatcaagtcgtaaaagaatcatagataggaatcttgtaactagcagttgacatgcataaaagtagttagttcagtttccaattttcgcttggttgtaataaggcggtcagtgacgtagcagtgacaacagcagcagcagtagcggcaagcattgcagtcccatggtagccccagctaccaaaacttctcgaactacattgacctgattcctgtttagcccaggatatgtaggaaatctttgaagcaagattcggtcagatctttcaaaaaatgcttcatacggagtggtctataggcaaaaatcgctcatacacgctcacttgatctttgcacgaaaacccttcgtgtttccgaacaaagaggggcagctgtgagcacgtgatttttgcttcacacgacaatcgctccaaaaagaaataaaaaaaatatatatataattggccccgctgtacaatttcggatttctgtgcggcaccttgtggatttatttgtgattttggcccattcttatttatttactttattaaaataaaattcaaaaaaatatatatgtgtcctgcgtaattcaaaccgtaattcggtcgttaaatagaaaatcgtgaataggcattttcgtccgtgattttatttggtttgactttaccggttttgaaatattttagtatgtgtgcaaataattgtatttgagtgtgtatttaattttaatttgattttttggcttagctttgttttaaaataaataagaaaagaagaaaaaaaataaaaaaaaaataaagaaaagaccccttccggacttgggccaattttaacaaaattggcccaaacaaacagcccaagacccaggcctgcccagcccaggtcacctgatgcccaggacgtccaaacgacgtcgtttgagtcgtgcctgatctgggccgttgatctcagagtgatcgacggccaagatcaatccccataacccatcaacaaacccgacccgtttacacccggaccaaacccaaaccctcaacatttgaaacgacaccgtttcacttaagaccatcagatccaaaccgtagatctagattgatctaacggttgagatcgacccacccactaactatataagcccaaatccttaccctaccccccctatccaataccccggcctcgtcgtcttcacccaaacccatccccttcaaaccctagccgcccctgcacactttcaccagaaacccggcggcctgaacgccggtgaccttccccttaacaccctagaacccccttgccatcctgaacatggatttgctaaccatgtagttcgaatcatcccctaggtcctcgaatcttcatttgaagattcgagttaaaactcggcttacaccaaccaaccccagcttcacaccagacactccccagacccccctcgtgaccaaaccatacttggtttggtccgaatctaaccagggaaacatgaatcccggatctgagttttggaactttgtagttcctcgtcactagttcatacccgttcgagccaaagaaattaaggtccaagggaccttaatcgaagtgtttctcatctgagaaacacttcgattaaagtccgttcagccttaagaaagtctgtccaagtccggttcaaggtttccgatttttcaagatttgaggtgagtctgccttcttcccttatttgtttggtccatgtgagggattagatgtctgttcatgttttgtgtcaatttgtgttttgaatttttaccaacttccgtttgtccaccttgtttgaaccactatgtttgtttgaacccctcatattctgataagacatatgtattgggttgtattccaaatttgtactgattatttaactcctcgagggtatttctgtttagtcagtataattcaaaccatgtgtcccatactttaaatgtctgatttttggcttcgattgtgtatgttaatgctaatatagtcgagtcgacatatgtcgtcaattagtttcagctacccgaacaaagttaaatcaatttgcttctgatgaacatttgcctgaaacaattaagaaccaagtccagttacttatagctgttaatatgatttcagaaacctaaggcttggtctgttaattgaaatctgagttgatggcatatgcacttgtgcacagcatgtgcattgtgcacagcctgtttccttcataaaaggggcttttaaatttaaaatgtgttgacagcatatgctgtcagatagattctactgcccataccttgctttaagtttaaaaaaaagtattaaaccttttaaaagctaaatctgccagggaatgttgatggaggttaatacttaaataactaatgggaatctgaaatggaaatgcacatgggaggggcatggtgatattctgaaaacaggctgttaaaaggttgagtttgagacttataaaaggggggataggaggaccatctgaggatagagatacacagagagagcatagatagaggggagttgaagttctggagatacagacagaattagagacaggattgagagatagaaatacatacacacacacacacaaaaggatagacattgaaccttaagagctgaataggaaaaacacaaacagagatagagagaggttaaaggatagaagctatacaaccaacaatcagaaaccttcttcctcctattgttattgggttttcagttgtttcaatttgttcaagccaattttgatcctttgaaatctcagttgtgtctattagttgagtgctttcattggtctactactatctggagtttctgattctactccactgggtgttgctgttatttggctattgctttctattggctatatttgcatctctgcactcgagctgggttcttgctgtattgctttgtctgctgctatttctgccctgctgctactgatagtgctgtgattgctgctgcattttgttgtcattatattctgctgactccccctttccttcaattgtcaaatatttccaggtacacaacctctgaaactttgtattgttgaaagtttgaagttgaaataaagaaaagaacagctgttcatgttataacattggtgttaaaaataggtcgaatattagtgggattgtattttactgcaaactgcaaacactttgtataaaactagcatacattctgctgagatggactgttagatagcgctgttcaatagcaataacaatatgatagacagcatgtttgatttgggatacgttcagttcagtataatactgtttggtttagttacgactgtataacatagagtcagggcaaacacttgtatgtatttctgcctagaccactgaatcgacaaatctgtggtattaggtctgggatagatgtatcccaaacaaactctcatgcagtcatattaaaagtctggctatgaatgccattttcgcttgtcagtttatttgttccaatgccggtttgatatcaggtttcggtacagattcttcgtttcgaaatgatgtaatgattgttgagaaaaactaataatcatttttgagttcaattagtagtaatttttcctaataatacatccgatttctttatcaatttcaaataggttagagtgttaagaatagaacttggaggtcgttaaaacataactcaatatatgttgttagtttgtttgcaatctcacttagcgaattaataagcatattcacttgttgaagacaaagaatgtcgtagctttcacctcatgaacaatcaatcaggtaatcaaacaagtttaggttcggcaaacataataaggattcagtccgtatttgtctaaaccagcaaaatacggcatcatccttccctttaaagataaatgtagtaaaaatgtagtccttgtagggtacccttctaaaataatgagacgagcctcgccgaatcaaaggcaaattgcggggccctcaataattggtcataataaatacttagaatttgggacgggctgtttagtgaattccactcccctccccgaagacaataacgcgttagattctttaggcgcgacttaatcaaattacattcctaaattcgggtgcgcatttatgtgacccaatttcaaatctcaatggagtcgaaatgtgttaacaattacgggtgcattgattgtgacgtggttcgagatacgttttcacgacgttgcaattctataaaaataaatgataataataaaagcggttaaaacttaataaaagcacataagtcacaacatgtatttaaatcagatatttagccattataacaatttaagcgaccgtgctagaaccacgggattcgagggtgcttaacaccttccctcgggtcaacagaattccttacttagaatttctggttcgcagacttcatttggaaaagtcgaaaatttcctcgatttgggattcaagataaaccggtgacttgggacaccaaaagccaaacctttcccaagtggcgactctgaattaaataaataatctcatttcgaatattgtcacttaaattggaaaaactacacccgcgcatttctaacccttcggggcgggcgcgcaaaaaggaggtgtgacaatgttctttctcccctttagtcattattaggccgtaaaaaatgacttcaagtggctattaagtttttcaagtaaacactcgttactgacgtggcatatgcatgtttggtaacaaagtgttcggcgcgtgaatgtcatttttcaattgtcaaatccaagaaaaaattaattaattacaagaaaattcaaaaaagataagaaaattttgcttgggtgcttcttatgcatctttggtcttcattatctggcattaaaattctgaattgatctaaatataatccttgccattgctctacaattcaagtttggaaagaagtatacgaaacacatcacaactctcaaatttggaaagaagtcttcgaaacccatcacaactcttgaaatttgagttcgtgttccatcattcttcattgtccaacactgtggaagaagctgggtttttcgatctgaaaattggaggtcgaaattgattgggtgtttaaaacctttgttgaaaacttctttgtgaaacagaatatacagatttaggtcgattggagttgattctattggctttggttcgaaatttttgaagtctattcgaagaagacatgtgggtcttttgatttttttgttgcttgtaaaaattgggtattgtggtttgatatcggtgttgattagagttcttatttcaagtttggactcatttggtgaaataacaattgagattggattgaaaaatttgagcaagtcggaagatggccgaagaaaactgctatattcttcaactcttgtgttcttcaatttttgaaattgggcttaaagtagcgtagcttaagcatttagtcagtagctacgtttaatttgttgggagttaggatgcaggtttaatttggagaaatggaatgagggaaagttgatggatgaaagaaagaagatgaaaaggtgtgtgtgtgtgcggggggggggggggctgtcagcgctggcttggttaattaaaagtaaggaaaaaataatttttttttactttaaatgtattctcttttttttgttaattcaaattacacgtgtcgtgttctaattggttcattagacacatcattagcaagtgtaactcacacatatagttgctgcgctcgagtgtttacttgaaatacttaataaccacttaaagtgtctaaatggtaaatgagtcacttaagatgtttagctagttgttgaggacaacttcaatgagccgtttatgtattttgccttatttgttccattttacatgcggatacaaaggtaaaactggatcaattacgacgtaatgcaaaaaaatgatctccccccgtgtccttgcatgtgcatgcaggtaaagcaaacactaagatatatatatgaggaagcagcttgcaagtatgactaacctactttacaaattacaattacaccacactggctcttctgttggtgggtatggggtcatggaaggaaagagacaaagggaaagtcggttgaattgttattagttactcagagtagtatctgtaaacactggtcgatggggcggatttggggcggaagggggtttgtgccaaaattataccatttatataaggtaaaatttattttttaactctatatattatatttgaattttctagacataggtctaagacatatctcattaattaagaggattcaaaacttatatgaaattactagttcgttggtcgattaattcagattcatgtccggccaactataggagaaggttctctagtttttcattctcaaggtttgaatccgagaattaagaacaaagagatttcgtttattattattattgaaaagtatttgtaagatattatgaggtgtcagataggcatatgatgtaattgggtgtcgcccttgaagaccgcctactaagttggtaatccaaacaaaagtactgtcaacgtatgtgtcttatttggtcataaattttgtcatcttgttcaaacttgaattgcctcccactctctaatgtctcttgttttcttttacttcatttttataatgggggtggagttctattattattctcatattttcctgagaattatttcttggatctggtgcctctgatgcacatttctgttgtatactgaactgaactgaagatctcggtacaaattacaaaaaccaatgaacccactggacacattttaaatattaaataaagatatcaactttaaaatacagtactagttttcaatgggctaaatgctgggatgactaatgtttggtaaacaaatttaatgctttgatgagacactgtagttagcaccaataaaaggaggggattttttcattcatatacaatatttgaaacttatttactaaaattgttctagttttatatattactagccataaataaggattacttaaataattatatacaattcattattagtgccttaaattaggaaatttaatagttgcgactaaggggctgagtttgctggattggttgtgcagtctgagtcgaggtttcatgggttccagatccgaggtagcaaaaggcaaagagaagtgggtgggtcgggtacaaatggagcaattttgatctgttgaactggaggaggaagagggaaaatcccactgattcgggggataggtccataaacaagaggttaggaaaaaatcgaaaagacgcgaatctgtcaagtcggatccggatggactacttggactcataccagaagaaaagttggtactaggacctacactaaacaatcttttcaaaggttgtcaaggagtttcaaagcttaaatctttaaacatggaacaacacttacgtttaagagtagagttccagtggttcccatgataggggtggcaaaatggttcaaacaaaacagttaaccattcatattatccattaaaaaatgagttggataatgaactatttaaaaatgggtcatatatggataaaaagcatattatccatttagaaaatgaataaccaatgagtctaacttttacatttgtaaagcctcaaattgggagttcctcgagttagggagcctaagaattctcccaaaaatgatcatatgtaagaagtcatggataatatggttatccatattatccgccggttaacccattttttatccgtattaaatatgggtcgggtcgggtaatttacccgtttttcattgtctgttttttacccgaaccatatccgacccgacacgtccgtttgccgctcctacctgatgatagtttcatcctcttcagaagtgaatgcacgatgcttcacttgaggggaaagctggttacaccatcggagccggtaggatacagatttgataaaattttatatttataataatatataaactaagaatgaattttatacaactaattatatagtatacaacttatctacaattttcatacactatttttttcccagtaaaagacatctaaaatatcatacaacttaaatacaatttttatataatattgttcaactttcatacgatacttaaataaataaaatatatataaaaataacataatacaatttttctagaattttactacaatttctgcagtataatgtatgtcatgtcttcttcttcttcttcttcttcttagagtttcaatctgaaattcagccaaaatcaggtctaatcttcaccaaaataccctcaaagttgagatataaacttcgaaccatattctcaattgtttgcaacaacacccaatccaaacaaataatgatttttgaaaacctaaattcgaattcaaagcttcaaagctttttaatggctgtcaatggtggaattgctgctctctttttctttgttttacattactggaattagggattgagagatagagagagacgtagagagaattcccaattatttgcaacaacatccaattcaaacaagtaatattttttgaaaacccaaattcgaattcaaagcttcaaagctttttaatggctatcaatggtggaactgctgctctcttgtgcaagatacgtgggggtggggggtgggatgtggagagagaaacgtgaggggggagtgagataaagagagagaaatgtggggggagggggggagtgattgtagaaattgattaattatccttaaatcctaaaaatgtatataattggtaattttgtatataggaggtaattaaagtgaaacttgagtagggagggtaataaagtttctaatactatatatgtatgtaaaaatctctaaaaggaaacggttccaagtgggcgcgtggtaattattgtgtgaaaatagcacgggctagtcaattttcagactcgtaattgaaaaatagtcagtgtttgcaaagttattgaaaaataacgactattttgttgtaacacaaaaaattctagcataatatactggaaagttcacatgtaaaaaattcgaactctagtatattatgctgaaatattttttggattttgaacagtatttttgttcagatttatctttacatgaaaagtggttaaatttcgattatttttgaaactgtggttatttttcaattttcacttgtaaatttggctatttttgaatttcacccaattatttttgagcgatttgcacaataggatacttcgggtgccacacttgattttttttaccccgcttatcctttgaatagaactttaagtttaacaattgttatctcttgtttgtctgatgagctaacacttttgacttttgattttaaatgtttgcccattgggcaagggaaggtcaaaaaattaagaccatacatttttaaagttatcgggcgtagttttcttaatttttttccctctctttttatctttcaattttgcatagttgggaggtggggttggggcctaaggtaaagttgaagttgagctggaaggggaccaaataataaatggagaaatggacccaataaaaagcaactgtggccgtggggctcaaaggaagaaaatttgctttcttttgcccctcctttctttattctttttttctaaacattttggttaattttttccttggataggtatcaagaaatacacctatcaaaattattattatttttaaaaagtactattccctctgtttcaatttatgtgaactcatttgattgggcacgaagtttaaaaaaaaagagaagacttttgaacttgtggtgtaaaatgaatcacatatattttgtgtggctataaatcattgcataaaggtaaattgtttccaaatagggaaagatgtcattctttttggcacagactaaaaaagaaataggttcacataaattgaaacggagggagtattaattaagatatgatagaagaacacatttcctttatgtaggaagtactagagaatgctttaaatcacgaggcttgggattgtcaacaaacaatttaacccactacaaaaaaaaggaggaaaaaaaagatgaagaaaagaagcaaatatagggggttaagtaaaaactcaatggtagagtaaaatttctttatattatcagtaacttattgtttacctcgaaaaatggggtaataattaaatgtgatttgtaattttaaagatatataatttattctaatactagtgaatatacaaataatattaagcttaaatatgaagaactgatgaaccaaactagtgtcgctataacaatgaggaccccaagctcgactttcttgggggcctcgaggtcagctaagaacaatgaagtatgaataataaagtaaaagtaataaaggtgaagaacacttgttgagcacgttaaacaagaaaagtagagtagaatattctattgcagtgaataatttgcgatgatccttacaaaataattggggtcccctttatataggagaagaaaattccaatatagtacattcctaattgtagtaaagaattatattggtacagctgtataacaacctagcacgaacctgtactatttcgtacatatcttatcctataatttatgccttgaaccatgtgtccttgaaacattctcgctctttcttgagtgccctcgagattgcactgccctcgatatcggtcgtgccaggccttcgattcgctttctcgaggtgtgtgtccctcagtcgggtccaacccctacctcgagtcgcccaaactcgaactcatagcccaattcatgacttcgaaatcgggctccttgattttgactgtatacagatagtcctcgcgttccttagagtaagatgataagaaacgatttgaacctcgaccttcccgaccctctcgtgataacgttatgcttgtgacataggaacttgaagtgatcagaaatgtcatgtcagcatgcttccccaaaacatcaaatacatttcagcttttgtcgcccacttgcgccgccggttccgttgtcggctttttataaataaggggttacttggctgaacaaaaactacacccatttccttgctttatctcttcctctaatcacctatttctatggttcaaatctgtgaccacagggccacatggcagcaactttaccagctattccaaggcttcctttttcaaagttttggctcgagacaacgagagaaaggcaccaaatccttcccgtatcagagaataatgtgaactttgcaccgctgctcatctctcttaacttcaacctagtgtggcgcttcattccttttgatttccatggaatgaggtggcactatcatctactaacttttgcatcccacaccggaacagagttccgaggatgaacattcttggattgttgttcgtgcatcttgcaaccccttttgttttttccttttgcttgttctttcttaatatattatggcccaaaatttcaatggaatgctcaatctcggctaccagagatataattgcatttatcgagggccatctgccaatcgtttccaaaatcggaaatggtgcctccgagaagagcatttccggagacgctactctcgaggtcgtggccttataagtaaattaagatctttggcttttgttttcttcttctttgttcatgtgtaagtatcctttgtgggtgccatagttatactttttaatcattttttggaactataaaaggatccttttgtatccttttctgtcacgccccgagcctggggcgagaccggcacttggtgcctcacctatccttgcgtaccacttgcgactaaaagactctgaacagttaatgtcatactttggccatcggccatattgcaaaacaactgtgaatgctgactaaatatcaatataaagctgggccgacaaggccgtcataattattgcagctgacagacagaccaaatatatatacagggcctacaagatcaacatattgcactaactgacagaatatgtctacaagcctctactagtggatatactgtgatcagaatagctcccccgacctactcataccatatatatacatatatacataagatgtacataaagctctagacccggcaactccgaaaggcatgaagcttaccgatcaagctgaactagggcaacacttaataaagaggcctacccgtctgtctgtctgaacctgcacgcatgaaatgtagcacctctaaaaaaggaacgccagtacgaaataatgtatcgagtacgtaaggcaatatactgaaagttgaaactgaactgaactgataatataattactgcaagtagctggaaatcaaaaataatctgaagatttgctcacctgctgatactgacttaactctctcaatatagtaagtaaaatagttgtccggccctataaggctcggtatatatatgtaactgctctgccgtagtaggctctctcataggcgctcggccacactaggttttgtatcttggctaactgggctcgctcataggcgcttggccacagtaggctcggtatataacttactatctgatctaaggtttcccaataggggcctgcccatcgattatagctcgatggtaataaaaataatttaatattgtatgtataaactctctactctcttgactagaagaagaaaatacgcaattaaatatgaagtcccgataagcagaatattgtaacttacaaaactagaaaaatatacgtaatttgtgagactagcaaaatatacgtaaattccgggatatgaatttttctttatgcctcattatcaaacttgtgtaatgacgagatcatgcaaaatgaaggaagaccttagtcttaacatacctggggtagggaaaaatccatatgatattcttggaaaaggttgcaccgtactcccttagaattgcaaaatcccgttgttattactccgtgtaatttcgtatgaatttctttaccaacctaagaattgtcgttgcttattgtaatatgaaaatctgatatgaactttgaaatcatcttcaaaatggaattttgatgctaaaatgagcataatggtagcctgggggcgagaccggcacttggtgcctcacctatccttgcgtactacttgcgactaagagactctgaacatataatctcgtactttggacatcggccacattgcaagacaactgcaaatgctgactaaatatcaatataaagctgggtcgacaaggccgtcataattattgcagctaacaaatagaccaaatatacatacagggcctataagcccaacatattgcactaactgacaggatatgtctacaagccgctactggtggatatactgtgatcggaacagctcccctgacctactcataccatatataaatatatacacaagatgtacataaagctttagagccaacaactccaaaaggcatggagcttaccgatcaagctgaactagggcaacacttaatgaggaggcatatccatctgcctgtctgtctgaacctgcacgcatgaaatgcaacacccccaaaaaagggacgtcagtacgaaataatgtaccgagtatgtaaggcaatataccgaaagctgaaagtgaactgaactgataatataattactgcaagtagctggaagtaaaagataatctgaagatatgctcacctactgatactgactcaactctctcaatatagtaagtaaaatagttgtccggccctataagactcggtatatatatgtaactgctatgtcgtagtaggatcgctcataggcacttggccattctaggttctgtatctcggccaactgggctcgctcataggcgttcggccacaataggctcagtatataacttaccatctgatcagaggttgccaaataggggtctgcccatcgattatagctcgatggtaataaaaataatttaatattgtatgtataaactctctgctctcttgactggaagaagaaaatacgcaattaaatatgaagtcccgataaggagaatattgtaacttacaaaactagaaaaatatatgtaatttgcgagactagcaaaatatacgtaaattcctggatctgaatttttctttatgcctcgttatcaaacttgtgtaatgacgagatcatgcaaaatgaaggaagaacttagccttaacatacctggagtagggtaaaatccatatgatattcttggaaatgattgcaccgtactcccttagaattgcaaaattccgttattgttacgccatataattttgcatgaatttctttaccaacctaagaattgtcgttgcttattgtaatatgaaaatctaatatgaacttttgaaatcatcttcaaaatagtattttgatgccaaaatgagcataatggtatatatcatgtatgacatttatttgttcttttccttgtactaatttatatctttatttccatcatttatttatttcctattatgaggtagtgcagcctacctttcatgaaatctaggtgtggggattcagatgttatattaaaaaaaaacaatgggtaaagatgactaatatctcaaattacttaaaattctacttatttttaatacactttatacattctactatcatggtcatatggtactagtccgtaaatatcgggtattaacgctcggccagtattttatcccaacatgccaaacttggacgaaaatttattttctttgacttgtttcacctctcaccttcacgaatttactcatcacttgtttgaaatatcatccttataatctccaaataaccttttccttggactgatgtcaattaccttacgacaaattcagcgtacaatactacaaggtgcaccattgtcgtaatttaatattgcgaagcgtaaaatcatcgtaatatagtactgcaaggcgtaacatcatcgtaatataataccgcagaacgaaatatcaacgtaatattgcgaggtataacactttcagcccatgctgaattttattctatctttattcgtaaaagactcgattttatgattttaatgcctatccaaaatattgagattaggacataataaacccttaggtttttaattgatcaatatgatacacctcgaggtttttgctaaccctctagttgagcctgaatatgaactctgaacgtcgggattctcgagctcgagttaggtgagagcaagatctcgagatgaaataaatccttagatttccttgcagtccccgggtgggaaacttctccacctcgggtagcccttaggcttttacggtcgagcgggcatatgctcgaacttgtaataaggatagcccttaggccttttcaccgtcttcaagtgagtgattcctcaaactcggatagcccttgggcttagtgatcgaatggatgccctactcgaactcaattcacaggttgccctttgatatttgacgaattaatccttgatgccttggtcctaatgcaaatatcataacatcagcggttgaaatgactgaaaagttgctttttgtacgattcccaaaatcattaattggaggtggctgacggtcggccttttggcttcctcagcacgcttaaatgacctttataaatagacagattccacaaccttacaaactttattcccatattgttttcaaagtttcattacccttttttcaatctccttgagctctctcttctcttcactaccatcttcttcattttcttggatctttcgtattgcaatggctaaaacctctaaaccagtttcccaaaaggaaaaagcttcatcatcttctcgatcgaccaagggtaaaccggaagtgcctcctcgtatcgaggagtgtattcccccgccatgtgaaataacatctgattttaaaatcaagaaacctatttcaacactaggccgatgcgagcccatgtctcgatatgtttgtctggtgaccaaggtcgagatcaagaaagtaaaggaggattgtaaatgggacaataaagaaatagtgattccatcctccgaggaggacatcaccacgtataaagtggggtacctgagcgtatacacctacccatttacgttgggacctgtaattccggctaagggtcccatagatccaattattcttgacttttgccaatgataccgagtgacactcggccagatctacccctccttctagcgaatcgtttgcttaatcaggttcttttcgagccaaatcgaggggatgtcctttacccttgatcatctgatcagactgtacagttccgacttcatcgtggcggcttgataaaattgcaatgccgatcattaaaatctttcttcgctagtatcgatgaggacaacgatcatgggtggattagcctgtttgtccaagtcaggacctccgatcttatccctgccgattggatgccgttcctcaatgagtggaacatgaaacatgagtatgcaaccggtttataccctgcgatcttttcttttccctggctttatatttttcattggtctaacctctttacgatggtgcaactgctgcttggtttctcggtggggtcccgggcctcgagggctgggtccgaaagtttggcctccgtctcctcttactcgaagcgctgctggcgatattgggctaagggtcgatgggaggccaaaaaccatggtgagctcttttgtttgttttcttgtgcttctactatgggatactgatcttagttttatgtaggccttggagacgccgttgatttgcggtcgaccccagttgatgaagtggaggttctgaagccttccaaagaacggaaaagaagaaaagagacatccgataatctctcgaagccaaagaagagcgtggattgaatgccaaaggacgatacaatgaccttatctccggaaatggcccaacaccttcgggagcaggaggaataagaagatgatgactacctgctagtaacccgcgaaaaaagaaaaatgttgatgctccaaagcccatcgacccggtggcggttgatatggctcaatccagagccgaagaaatttcttaggggagttcaaacatagtccccgaaccatcatccagaaagaaagcacctcgcctaggagatcatttggagggcgaggccgaacgacctgaccctgagcctcttcagataagagaaaatgccccgagtggatcacttggggtgatcaacgtggatgattcgcctcctggcctcgatttctctgagggacaaatccgaaatgcccataatatgaggttttctaaagtggaagcaagccatgaagggcatgacatctttcgagaatgtctcgcagggcttgaggatggtcccgaccccgatgcctttttcatttttgatgaggctcgtagtctctttaaacaagtgaatttatgcctgcacctttgttacttcctgttctgaatctatcttttttcctttttcatgaaggttgtggtactccataaaagggcattttccacgtcccaagttgatcttgctcgatgcgaggctaagcttaagatgactttggaggagagggacatcgtcaaagccctctatgctaaaaaagagatggagatcttcgagttgagctaaggtaggcatgccaaggtcgagccgagtatgttgagaaggtaacacaactcttgaaggtctgttacatacctgtttattttagcgactgacgcttttaattttgcagtttcattagaaggccgacttggaggtgcagcttcgggagcagcttaagatgagagaagctgagaccctagggtagaggcaaggcatggacaatctcgcctctgagaaggaaactctaagagagcagttggcttcgctcgaacaccagcttcaaggtgtgaaggaagaaagcctaaatcggggcctcgaaatcgaggagcttaaagccagatctgctgctgagttggccaaggccaattctgatgttgcgacaattatgtcttcgtatcgagctggtgtcgaagctgctaatgctcgggcaagggagatttcttctacggtggaggctaagttatcaagtgcccttgaccatgctaggcgacaaccccggaggatgaccctcgaggagatacatgctcgcggcttcgatctttcagccgatattgaagcggagaagattttgaaagaagaggcggccgctctgattttcgatgaagatgatccagctagtgtttctgagcgtgaaagatatggggatgaggttcccgaggatgaggctccccaagatgcgactcatgaagatgcagctgctgaggatgtgaccccgaagtagctttatgtcactttattttgttttcttgtaagcctcccttgtataaatatttcctgtaatcaccttttggaaatacgatggaaactttttatctcgtctttggttagtgttggatttaacattgcctttatttatggaagacttcgattgaatgattagttcgaggatcggtttggggttcggggtattacaaaccctgagatctttatcgatagtataataattttttagctgagtttaaatcgatccgttatgagctcgggatattgtgaacctcgagtctatatcgaaatgaaagtagagtctcgaactgtaagtttttggccgttaagcctttcgagattggcccttaggctcttatatatcggtccttaggcttttttttaagctgccccttaggctcttgcatatcggcccttaggatattttaagctggcccttaggctctttatattaggccgtttcggcctctaaaatggctatataattttttcctcatttcggttaaaagactctagtgaaatttagttatgacatagcatgtatttttgtacccgttcggttttctgaaggctcgacgtattgggaccttttagtcatttcgtttgtgtaggcataatcaaatgcctcttgaggtattttcgaaggctgaatttatcaaacccctttatattttgcttttgccgatggtagcctgatttaatcggtttttacaaagtgtttgaatgcctttaatttatagcggaagtcggacgtctccgagccgcattatctccgactttataccaccgtagtctttagtatggccatagcctttatttgaccgtagtctttagtatggtcatagccttcgggaacgtcacttggacttgtttcccgataactttccaaacttattcgagaagttagtccccgagaatattggacttggcctttgtttcgagggggtgcctctttgaggtcttattaatccaaatttttgatgacagtccccgagtattcggggtgttgctatgctttgactcttaagttgttcccgtgggatgtagagttcatgtaatggtagacgtctttgaaacactaagtgttttttatattaacaaaattggtacatttgtacatactttgttgtgggggcttgactgatatatggacattattcatctgaccgtttggcttattacaaagttttcctatcgaggttttcttaagcatgaagtattttccttgaaaatataacctccgagagtgatgccccccccagtattcggggttgattaaaaaaaaacctggatattgtcgagttttccttaggcgacgcatagttgttgcctcgttaaaaccttgccggtaaaacccatttgggaaaaaatccgagccaaggaaaaaaagtgcaacgcatgctttaaagcctatggtcttcgtgtagaaatgggtgtcttcgagatcgcgggtctttgaaagcttctatcatgccgagcttgtaagatcctttaccaacggctccgaggtctcgctattcatgatcatagtatcttccagagccttgacctgctcggggatgattcttaatgccatgatttgacaccatgagcccgagaaactcactcttgccaactctgaaggcacatttctctaggttgagcttcgtgccgcgttgccccgaaacgttggttgtttcctgcaaatgaattaaaatggtcctctgctcacagggacctaaccagtcatatcatgaatataagctttcgttattttacctgtttgttcttcgtacatccggttgactggatattgatacgaagtttttcgaactaggggcctccctttttgctttactggtttgaacctggggctgttgctcagtctatgcgtggtgatttaaggctaaatccctgtcatatctgaacagggccaagcaatgcaatctatatcatcaataataaacaaaatgagttcctcgagcattttcataatagcggggtcagtccccgagtcattttcatcaggcctcgtaggttctgcatgccgagtgttcactagttcggttgtgttaagagttctgttctaactctgaagctgagcgatggcaacttgctaagtttgcagcatctcgtatatcacttggaggctgactcctccttcttccatctctcatgcttcttggcctcctgctcggacttccctgtgtgtgttccttgcggggtctgtgcctgcgtccgtatttagagcgttgtgcgaactgatatcaactggctccacattcagcactcccttagcctgaaatcaacgaatctttgacaagaaaaagtatgaagaataatgtgtgttatcagaaaactagcactaaaataatcactattatctttagccccacggtgggcgctaaactatttacctcgaatatgggggtaacaataaaatgtgatttgtgattttaaagatatgtgatttgttctaatactaatgaatatacaactaatattaagtttaaatatgaagaattgatgaactaaaccaatgttgctataacaatgaggaccccgagcttgactttcttggggggctcgaggtcagctaagagcaatgcagtatggataataaagtaaaagcaataaagctgaagaacagttgttgagtgcgttaaacaagaaaagcagagtagaatattctattgcagtgaataatgtaagatgatccttacaaaataattggggtcccctttatataggaggagaaaaccccaatgtagtacattcctaattttagtaaataattatattggtacagctgtataacaacctagtacggacctgtactatttcgtacagatcttatcctataatttatgccctgacccacgtgtccttgagaaattcccgatctttcttgagtgccctcgagattgccctgccctcgatattggtcgtgtcaggccttcgatacgcttcctcgaggtgtgtgtccctcagacgggtccgaccgctacctccagccgcccgaactctaactcatagcccaattcaagacttcgaaatcgggctccttgattttgaccgtatacacttatactcttaatatacactcagaatgctctcctttccgaatttcccaattttttttaaatggttacttagttaaagataaatatgtgagtgctatattacgttagctgacatttctataggagaagttcacgtacacttacttatggagccactattgaaattatactcgcatttcaaaattatccgccagaatttgaatttcttctatcttttcaatgcaattttagaataagatctaaagttcttttattttttaagtgcaacttcaaaaactgaatctcaagtacttctatcattccaatgcaacttcaaaaaaaaatcaaatcttaaatatttcaacctcttcaatgcaactttagaaaccaaatcttgttctgaaacataaagttgttattcgaatttcaataattcaacatatgattcaatgtccaaatctgctccaaataaactcaaatttgaaacataactttcacatatcattaaaatcaaagtccaatcatcaaattattaaaacaacaacaaatctaactaacttaagcacaacctacaatagtgttttgcaactacgaaaaagaagaaaaaaccaaacaactcctagatacaagggacatgaagtcatgaatacaaaaagaaaaagatagtattgaatacatgaaacatgaatatacagaagatgcaagcatgaccacataggatgtcccatgaaatttttacgatttctacgaggcagtagcgcatagatttctcaaaaaaatatacttatcattttgctgagcatgtttagcgatgaaacttatttcacttttttcgaaatcagtgttttaccataaaattttcaacttttacttgaagatggattttggaatttttctaaaatttgaaaaactccaaaaagctatttttcaaaattttcactcagatcactcacaaaattcaaaaaacaacccaaaattatattcatgtccaaacacagctctaattttcaaatatcattttcacttgaattttttttcttcactttcttttaaattttacaattcttatgtccaaacgcccatgttgtgtcggtggaagtcgggagaaattcaaagatagccagatttataagtggtcattcaaaaattgccatagtttcaaaagtaatcgaaatttagcctcttttcatgtaaagataaaatctaaatgaaaacactgttcaaaatccagaagatactccagcataatatattggaattccagcataatatactggagttccagcataagtatatactggagttccagtataatatactggacttccagcataatatactggagttccaatataatatatcggtccagtataatatgctggaagttcatacacatgtgttccaatctccaatatattatgctggaactttctgcgtgttggtgttccagcataatatgctggaagttcatacacaggtgcaccgatctccagtttattatgctggaactttccgtgttgcagcaaaatagtgactatttttcaatgatttacaaactctggctatttttgaatgatcagtccaaaattagcttttactggggcatttgcatctatatccgctttttgggtcacgttttaacttgtgcccgctttgcaaaaaaaattgaaagcgtacctacttttttgcgtaacttcagcatactgggctgaagtagtaaaggcaatcacgcaaaacttcagcattctagtagacgggccagaagtagcaagtgtgttgaaccaagtgtgctgaagtttttatttataattgctgaacttaagcatagtagctgaagttttgttatatatttgctaaagtttttgtttgtaattgcactaataagctgaagtttttttgtccttgattcattagttttgtcattaagctttttcaaaaacttcaacagaagatgctgaagttatttagttcatttataaaacttcagcactagataagctgaagttatttttgtcctggataagctttttcaaaaacttcagcagaagatgctgaagttatttagttcttttataaaaacttcagcactaaataagctgaagtttttttgtcctggatcattagttttgtcataaaggtttttcaaaaattttagcagaagatgctgaagttatttagttcatttgtaaaaacttcaccactatataagctgaagttttttgaaaaatctttctagcatactagataaataatcagattgccaacaacatctaaatcataatttccgaaacaataaatgtgaaaagaacagaattatcatgaaaagaatcactaagtgtgaccttaaattttccgtacgtgaaaatattcacaaattattgtctactaacttacgtaattatttataatttatttttaaataatctgataaacatacttatggcaatcatcccatgaactaaagttttatagcagcaccaacagcagcagcagaagaagaagaagaagaaaacgacggaggagaaaaggagttgaagttgtttaaaaagtgggtacaaattaaaactttaaaaaaatgggtataggttaaatgggagcgaccaaataggatgccccgtgcaatttttaaatttttacttggaagtccccctcggagcccaacaaatctttgccttttgggcggcccattttagttcacaatctggcccaacgtttgtggcctgctgctcttctttttctctacattgttctttttagttccttcctcactttatcttacctacaagccaaaagttgagctctcaactaagtggctactaaagtgaaagcgtgaaaactgaaaagcatttaaggtttatgttgaataaggaaaagaaaaaatgcactaaaagtggctgtttccgtttaacaagtgtttgaatctaaatctctcaaggtgttaagtgcatttctgttttattgttttacaaccacttaatgagagctagatcaatcagaacagtggcggacgcacgtggtggcaagcgggttcaattgaacccgagttgaacccccttcttcaaaaaacaatactgtgtatatgtataaattacaattaaagctgcataaattttgtataaagatgttatttgaacccacttgacaactactattttacaacttatgtacttctaagattgaacccgcataaaaaaaaacttgggttcgccactgatcaaaagaacaaggattcaaatagcaattggaagtgatattcatagcaaaaggctctttacaataagattttatctaatataatattataactatcaaaaagttaacatttctaattgttagataaagataaattatatatattcatatgtttgattcaaatattttaatcttaaaataacaaattataacaaacgggtccctagctttgatcctgggcaccactaacaagatgatgcaagttgggccaagccaacaacatgctttaaatcacaaagaaaattaatttagggaaaatgatattgtatatccgctcttaaaataatattcgaaaaatatatatttatgtatatatattcatttctgtatgttatatataaaaatttaagaatttatctgggtagcacgtgtatgtatgctgcattggatccataattattgtcacgcatggtctcatcaatataatctttatgctcctttaggctatttcattcccagttttcgagcacaactccacgcagcatctggctctatttacaaaaaggaccccttaacatactttgcaactaattttcaatatatgaaaaagaaactgcaatcataaaataagagaaaaatatttttactactcaaatcaattgtgaatacaattctatttctccttgattcttctctcctgattatctccgtgattcgagagctgaagccgtgtatttctcgaatgtaggatgatacagaccacctgggaatgtatttgatctccagcttcttgaactatttgattgttaaaagcatccggccatattttgatctctttgtgaatattccaatagtttatgggattttgagacaccttgtatccctttatataggtgtgagttagggtttagggtagagtaacttccaagaaacctaatatactcttaggatttcaagagtcctgtagtatctttaatttaggatttggcttgattccttcaaatttcgatatctacaaataccctctacttcaaggtttatcagggtgtaggcttgccgaaactttaagacgagacttgaagtactctaccgtcgcaacaaatagttttgaaacttggagttttcgatttacaggaggaagagatgaagggcagaactggtccaactgggcgtgccaatttgtttgcaacaaatttatgcagagaaaaataaaactgcaatcacaaacaactataaagaaaaaagaattttattgataaacattgtaggttacaactctgtttatcccttgattcttccctctgatttattatccataattccggccatattttgatctctttgtgaatatcccaagagtttatgggattttgagacacctcttcaagggaatacatatccctttatataggtgtgagttaggatttagggtagagtaatctccaagaaaccctaatagattcctaggatttcaagagtcacgtagtatctttaatttaggatttggcttgattccttaaaaatcgatgtctacatataccacgtgtgatcgaggttgtttggttgggaaacaagctatttcataattaattatttcgagattagttatctcatcaccccataaggataaagaaacactacattcccgggataactaatcccgaaattagttataccacaattttatcccaaccaaacataggataaactcatctcaaatttaatcctaggattaattatccctcgtaccaaacaagccccttaggctcttagctagctcctatggcatggaaataacaaggcattttttctcttggatcatgtagtataacactaattttagagcaacattcaacggtaaagaaaattaagatagatgtgaggacaaattaaatcaaaacagtgcaactgactcatatcattggcgagtgattttcacagctacaagtttagtaaagccccagttcttctgtattgcagttcagttgaatgcataataacaactagaagcaaacaattgcagaaggatcaactaatacaatcctagacaagaattctatatcctaaactaaaagaactcaaagtcaagatatttacccccaggttttgcatctgttcccaccactcttttactcgtattgccaaccccaagagggttcacttgcccaaactttgcaggaagctccgcctcaatgggtcttggcacttcgggtggcgtactgcaacgtatcagagcccaattaacgccttcaaagaaaggatgctgcttgatctcagttgctcctcttttcaccccaagtcggttttgaggctctttaacaagcaagccacgtatcagatcacggctggcataactggttgcaggagactctggaaacctgagctgttggcctactacattgaaaagagttgccctgtttcctgatcccttgaatggggtcttaccatatagtagttcatgcaggaaaataccaaatgtccaccaatcaactgcactgccgtggccttctcccttgataatctcgggggccaagtattcatgagtcccaacaaatgacatagagcgtgccgaagtaggttctgcgactagctcaggcagtgcattagctggaggcccagtctcggctcgaggcttaggtgatcttttcttgcttttttgattaaatatacggggaaggaagcatgctggttgaatgcatacagatgtgggctcaatacatgctggctgcacacagaatgcggctccttttttagaaggatcgccagacgatgtccttatgagcgtgggtgaaactgcacatcttagggataggtcaaaatctgaaagcataatgtggccatcgtcacgcacaagaacattttcaggttttaagtctctgtacacaacaccaagcatgtgtagatattcaagcgccagtagaacttctgctgcataaaacctgtggcagaaacgcggggtttgttaaagtttgattaaggaactcaacagcttaaacagaaatgtgagggtaaagattctaaaatctcccaaatgaagaaaatgtggaagattgttagcacgaaaagccctttaataatattagttaaccagactttaataatatcaatagacatgtcattacatatttaccaccttctcttcttaagacccaatgactggaaaaaacttccaagtaggatcaaactatttggtatgggaggatcccaaatatggattgagtgggacaaacatcaaaatccaagagtgataaatatctaatttggtctgagttgatatgacatgggaaacaatcacttttttttttggcaagtaaaggtgcaattaatggcagataaagaaattctttttgtggacgagagttaataaaaaaagtcatattagtaaccatatcctctacaggggagagctttttgtttgtcagggtaccaggctcgaactcttgaccgcatgaagaggactctctcctctacaggggagagcttacatgttcagaagtcagaacgatggtgcaagagaaatggatgtgataaatcataacatctaaggaatgccaaaataagcagaggcttatgcttatgtcaggactacatgtgaaaggggaggataatttttatgctgcatattctagttctagatagaatgataaaagcataccttgcagcatattccgaaaaatgcttcccaggttgtcgctgtcgtagagtatgtaaatctcctccaggacaatattccatgaccaaacatgagaagcgatcggtctcaaaatgagtgtacaaggttggcaagaatggatggtctaataactgcaggatttctctttctgtctgagcacgagtcagtttcttcctgctcgcaagtgaagccttatccatcactttcattgcaaaatagcagcgagtcccgctaagctcagaaagataaacactgccaatgtctccacaaccaagtcttttgagtaacctaaagtgactcattcctaaaataccatcacgtgcccgaatcgcgagaatagccttccatctaggatcatttcctttgtgaggcttattggcactgccagtaatgttactccaattactatcatcactaagcccactgctgtcacttgctctgctaaggctagttttaccgctttcaagtgaatccccacgaatgctcccttttgtgctctcatagtttctgtccacactaagcatgccatcgctcatgatcacatcactcctatacgtgcttgtgcaactgttgacaatgctcatagatctcaccacaccagtactatcaatgctactaagtgggcttacattgccacttggaggcagcgatgcatcccaaatacattctttctcttcggagtcaggaggcagacttgcttctgtgttttgagatggacgaggaattgtaaacggagaggagattacactcagatcatttggctcttcaaccaagctctctgcaggtgaaagaagagatgggctcggtttcacattaggaacccggattgaaagatcatctaggaaaggacccttcaaagacatgcttttcactaagcatttcccatctgcttttttctgaccaatgggtacgtacactggtctcattaggtctgtatcaacaggttccggaggatgactcgctccatgaaatgaagtagagccactgtcttcaagtgaatcatcactgcgcttgactgaaccagcatctatcatgagttcctcttcctcctgatacgaggtctttcctttccatgtttgtctcagaacagacaagtcaaaatctcggaagtcctgcacattgcatttaacaccgatctccttcctggaagttgaaaaggcatgtgtcaccttagcctctaaagggaattgcctcggtggttgttttacttcatgtatcctttccatctccggttactattaacatcacaggtacctcaccagaagaaagctctgaagaaagcgcaaaaatcagtaaaacattatccacacatgattgtactacaaatcaaatctactaggaccatttcaattacaagtattacagcacatgaaagatttctttttcactaaaaaggtcttcatcctctatgaacacattagagtaaacacaaccacattacaaaatcttcaaatttcagaattttaacgcgcagttttactatgtgatgtggtaagtaataaagatattttgtagtaagagacatccaattaggcaaatattattatttttacaatcaccaaaatattccataattttaacaagttccattaattacacaatgagataaccctcaagaagctctcatagaaaaccttaagtccccaagtgacgtgacaatcaacttctaagaaaaccatagcccccctaaaaaaaaaaggaaaatagtgctaaattaactgtgtttctcacatttcacagtaacactcaatgaagcatcagcagatctagctttcggctcgattatataaaagtgaaaaaagaaatttaaaatgtgaatacataataaacgtgcccactgcccactttaataccactgtctctatattgggtggaaatttttgccctaaacagcggaactacttcaaaatactagaaccaaaaaaagagactcaaaaatgacactcccattaaataaattaaagaaagcagaaatttaccagtacaataggagatctgtaaaatcctcaactggttctttattttcaagctagagctcctactatacttctttctctgtgtttgttactctctcaaacagagcatttgatttttttggcagaaaattgatttattgttagccaaacgttgatgctatatggctctacaggcgaaaacagaaacgatttggcttcagtggtgaagattttggtgatttggttgcctttagctaggtgttgttgtatttggtaaggctttagtcatgtgttcactgtcatatgaaaactgatgataacacaaaagtgaaagtgtgtgctttatttatttatatttattttaaagaagaagaaaaagagggagaggttgcagttatgaacttgggtattgggatgcacacatacacaaaaattgctatttccccactttaactactctctctggtccactcttaattacgtactagtattcatatccgcatgttatgcgaaaaatgttatatataatttttcattagaaaatattatttaaaaaatataatatacacaaataaacatgtaatgatattattttatgaacatgtaaatgcaatcgatatccattgttttgcttcttctataatttatttattttttaaaattggaagttctcatcatattcttgtttggtatagatagattttgcttgtttaaaattgaaaattttctgatcatcctctccttgttttgcctctcatattatacaagatatatttttttaaacaaaattagaatttttttttttggtgatgcacttattatccgatcattgttttgcctctcctattatatataaataaaaaatatagattttattttcaatataaagttttaatttttatattttttactatgttgattgtgatcatttcattattatatcttttattttgtgtgaattgataattgtttgactcaaaagatattgaaacttttttgaataaatcaatcaaagaggaagtggtaaatcgtagtcaaacttaattgattccagaccaagagatttcataataataaatgtgtatgggatgacgaaaatatcgacaatctcattaagattcaatattgccttcttcctcagtccctgaggaaagaatattacaattgtttttttatgtacaagatacaagaatgaagctttgttcttattttccttctgtggaaaaaatggagagaagccttccccttgaaagccttcctgggttatatatatataattgaaatccattcaccctcaccatgaattgacgcgctcgggccagtggtgcgttctggtcgtgattccaggcgttgctcttttcgatttgtcggatattgtggaggagaaatgaagtggactctattgacttcattacccgattgctaaaaagggggtcgtgggcaacctggtcgaggtggtcatattttgaccaatacaattagtctctccatctgtcggggccatcctttatcgggctcgacagatggatcatgtttgcaacgtagtcgagaggaatctgacccccaactttctgttccttagtcgtgttttgtggactttttggcggagtggaggttttgtttcgatactcgtggaccgttgcgatgatttcgaaattgaaacgtcggttggcaatgaagcgttagttcgtggatgccaccattatgacacacatacctgggaaattgaaacgtaccgtgccctatcggattcaaatggtgactcttgggtttcgtgctcggggaatttatgtctcttataaataggggaacttgtcatttgagtaattcacttcatcattcgtttgaaagagttcttcagatatcactttttcttataccctgaattcttgcttaccttcttgctcactacaacttttaatcttttcttcgtatcacttttttcggagagttttctgctaaaaatggctggcaattcttctcgtgataattttcctgtcgttgatccggtaacagagagctctgttcaggccaccggagaagtgaatgtggtagaggatgaagagattccctcggtagataaaattctgcctcgcctagggagggacgcgactgacttcagtttcggcgatagagcagagctggaacacgtcgcttccgttgtgagggaaaggggaattgtaaagttgagggaacggtggggaatctccagtttcgtcgagatttggctggcggagggggacgatagaattcacttcgaccgccccggatattgtgtgttctacgcctaccccttcattgtagggtactcacttcctctccccatgttggtggtagatttctatcgctactacgaggtgtgccctgcccatctttctccttttttgtacaagttgtttcttatgctactcaaatatgcggaacttgccggtcgtgaggtcactttgagcaatatgcttagaatttttgctccacaactgattcgaggtacgatgattcatgcgcgtcctcggggatcaaagggtctagtggtgaagatggacgatagaactaatcgtcgtttctatgaaaattacttttatatgtggaccgagcatattgtggcggacccgactggattcctcgagagatggaactttgcgcgtaagtttgcgtctttaattaatgaaatgttcgaccattttccgcgaatgctaaattgctttgtttttctgcagctgagagattgcccctgccgcctgttgaagggattcgcaaatgggtggaggccattcttcccacacagtgggagttcgtacctggttgactttccatgagaggtttggacgcaagcctcttacaggtgagatgatgtccttatctactatttcctccctttttttgttatttagcctcttatgcatcgttcgtcattgtcagggagggtgcggagagcaagggcccctcagctagcctttcgccagccggccgcatttgctcgtcttgtcctgtacttgctgcacgcccttcgtcgaaggctgcttcggttgaatctgcggccttggttactctagcgagggccacttctcaggacgaggtcccgactagtgtcgtccgtcctacgaacgagtcaccgtcgactggggaagaggaagggccatcgaagagacaaagagtagagtttgagatggcgcctccgacagtgattcacctggatgattctccactgacgggcttaggagaaggtgttgttgcggcgtcttccctagaggcaaagcggattgttgaaattggtgctggcggtcaatgctcggaaactccggctgtcgccatggctcagccagaagtccttgctgttactggcgatcaacgccttgtcgtggtagagaaccagacctctggcgccgttgttgtgatttctgacgtgccctcctcttctgcagcggatcgtgctcctcctttaacagcagaaaggggaaaaggcatgatggttgacgagtatgagtccgagtcatacctggatcctgataatgtcaggatgttcgaggagggccttactcattcggtggttcacgcgggtggatcggctcacattcttcagatcccttctagcgttaacctcttggcggagggggaggatctggtgccgtaatttagccttttatgtttagaagctgagaatgagtcccttcgagatttccccgatgctgagttgagggatgaggtagccgtcatgggcttgagggtacgttacattttgtttttgctttaggcttttcccctattcgaaagtattagtttaacctcgtccttatgattttcagacatacatggtagaggtagaaaacatttgcagggccaacgtccggacaaggactttcttaaagatgctggagaagtatcgtcgctaccgcgacagatgtcacgatatgcatgagcggctgaggacggatccccgtaatcaggttctcgataaggagttcaaaaaaagggaccaggaattgatgcaaacgatccgtagtaagtgcgaactcgaggagcagcttcgcatcaaggacgaggagctcgagttgggcaaggggatcgcggcggagtatgagcatttgcagggtaggttgaggtcaatgcagtcagagatagaccagaacttggtcaaggttgaggcgatgtgtacagagtggatgaggaagttgaccgcgatggagagcaaagtcgtcggtttggagaacattgagagtgcttggtctgaggctttggcgacggcatcggccttggaggacaccatccacgtactccaatctgaacaggagtcggagagagtgacagctacccttagggaggcaaggctcgaggaacgcattggaacgattgatcaggaggcgtcgattctaggagatcgagtcacggccttggaggcgaaaaatgcatgactacaggcccaggttgcgtcatcctccgctgtcgttcctcgccaagtgcatgagctctgggtttatgctgaagcccagcgggacatctataagagtttgtaggaggcgggcaccgtggctgaggctgcttacgaggaagcgcgagtgaaggctcacgaggctcgcatcaactgtggatacgatgcggcgacacccgaagccaataggggtgcggatgatgataatgatgagcctcgtggagatggtgacgatagtggcgatgatgatagcggtgatgacgccgaatgaagagtgatgtcctttgtttttatttttattttatttgttgattgtcgtctgttcgttccgtcttctttttctcttcttctttcctctttttttttattggttggcctgggccatatgtaagcggcgatagcccgcactatgacattgcttaaataaaagtttccttcttcgctatttgccttgtacttcactttttattctgattgttcatggccttagagcgagatagaggctcgcccaacgagtcccggtttttcttttcctctggtggtggtcaaactcttttcctttttggtgaaggctcttggccttaaagggagttatttcgaacttatcgaaataacagcccgtcgttgttcgagcaaggttgagccttccttttttctttaacggcgaaggctcttggccttaaagggtattatattgaactcatcgaaataatagtttgttgatgttcgagcaaggtcgaacctttccttttctttgatagcgaagccccttggccttgaagggtgttatttcgaactcatcgaaataacagcccgtcgacgttcgaacaaagtcgatcttttcccatttctttgatggcgaaggcccttggccttaatggctgttatttttaactcatcgaaataacatcccatcgacgttcgagcgaggtcgaaccctttctttcgtttgatggtgaaggtccttgtccttaaagggtgttatttcgaacttatcgaaataacgtcccgtcgatgttcgagcgaggtcgaacctttcctttttctatggtggcgaaggcccttggccttgaagggtgttatttcgaacttatcgaaataacaacctgtcgatgttcgagcgagatcgaacctttcctttttctttgatggcgaaggcccttggccttgaagggtgttatttcgaacttatcaaaataacagaccgtcgaagttcgagcgaggtcgaacctttcctttttctttgatggcgaaggccattggacttaaagagtattattccgaactcatcaaaataacagcccgtcgacgttcgagcgaggtcgaaccccttctttcgtttgatggcgaagcccttggccttaaagggtgttatttcgaactcatcgaaataacagcatgtcgatgttcgagcgaggtcaaacccttcctttttctttgatggcgaaggcccttgtccttaaagggtgttatttcgaactcatcgaaataacaactcgccgacgttcaagcgaggtcaaaccccttctttcgtttgatagcgaaggcccttggccttaaatggtgttatttcaaactcatcgaaataatagcctatcgacgttcgagcgaggtcgaacgccttattttgtttgatggtgaaggccctaggccttaaagggtgttatttcgaactcttcgaaataatggcccgtcgatgttcgagcgaggtcgaaccccttctttcgtttgatggagaaggcccttggccttaaagggtgttatttcgaactcatcgaaataatggcccgtcaatgttcgagcgaggttgaacctttcctttttctttgatggcgaaggcccttggccttaaagggtgttatttcgatctcatcaaaataacagcccgtcgacgttcgagcgaggtcgaaccccttctttcatttgatggcgaaggcccttggccttaaaaggtgttatttcgaactcatcgaaatgacaacccatcgatgttcgagcgaggtcgatcgcttcctttttctttgatggcaaaggcccttggccttaaagggtgttatttcgaacttatcgaaataacagcccgtcaatgttcgagcgaggtcaaaccccttcttttgtttgatggcgaaggcccttggacttaaagggtgttttttcgaacacatctaaataacggcccgtcgatgttcgagcgaggtcaaaccctttctttttctttgatggcgaaggcccttggccttaaaatgtgttatttcgaactcatcgaaataacagcccgtcgacgttcgagcgaggtcgacgttcgagcgaggtcgaacccttctttcgtttgatggcgaaggctttcgccttaaagggtgttatttcgaactcatcgaaataacggcccatcgatgtttaagcgaggtcgaacccttcctttttctttgatggcgaaggcccttgaccttaaagggtattatttcgaactcatcgaaataacggtctatcgatgttcgatcaaggtcgaacccttcctttttctttgatggcgaaggcccttggccttaaagggtgttatttcaaactcattgaaataacagcccatcgacgttcgagcgaggtcgaaccccttctttcgttttatggcgaaggccctaggccttaaagcgtgtcatttcgaactcatcgaaataacggcccatccatgttcgagcgaggttgaacccttcctttttttttgatggcgaaggcccttggccttaaagggtgttatttcaaactcatcaaaataacagcccgtcaaccttcgagcgaggtcgaaccccttctttcgtttgatggtgaaggcccttggccttaaagggagttatttagaactcatcgaaataacggcccgtcgatgttcgagcgaggtcgaacctttcctttttctttgatggcgaaggcccttagccttaaagggtgttatttcgaactcatcaaaataacagcccgtcaacgttcgtgcgaggtcgaaccctttctttcgtttgatagcgaaggcccttggccttaaaaaatgttatttcgaactcatcgaaataacagcccgttgacttccgagcgaggttgaaccccttctttcatttgatggcgaaggcccttggccttaaagggtgttattttgaactcattgaaataacgacccatcgatgttcgagcgaggtcgaacctttcctttttctttgatggcgaaggcccttggccttaaagggtattatttcgaactcatcgaaatatcagcccgtcgacattcgagcaaggtcgaaccccttcattcatttgatggcgacgacccttggccttaaagggtattatttcgaactcatcgaaataacggtctatttatgttcgtgcgatgtcgaacctttcctttttctttgatggcgaaggcccttggccttaaatggtgttatttcgaactcatcaaaataacagcccgtcgacgttcgagtgaggtcgaacctcttctttcgtttgatggcaaaggcccttggccttaaagggtgttatttcgaactcatcgaaataacggcccatcgatgttcgagcaatgtcgaacccttccttttttctttgatgtcgaaggcccttggccttaaagggtgttatttcgaacttatcaaaataacagcccattgacgttcgagcgaggtcagacctttctagtttatagagggtctggcatcctctgtggaagtcccagtttgtttggtatagcttgcatcagttggttcaacactggtggacacgaggcgtcaacgtttcgcataggcttgcgctttgcgcgcattatacttttcctgtcttactccggtcgttcagctcggagatgctgccggtagggagggcttcggctgcatcgaagtgatttttgttcttcaatctagatgtccttgcgtacattcgtccacgcggatcttatgtgcttaatttgacgaagtgtgagaggtgagggtgagatgttctttgctcccgtccagtggtccggtgggggaggggggttggattgcaacatcgtttgccttgtttaggatattcgcagctgatggggcgaggaattccaggtttcatgaattcatttgtttctccttccctcaacgcgctattcccatgtctcgcgtgagttagattctcctttcgtgcttctcttggtgaatgattgtgtttctcggctttgatctgggaaaaactaggagttttcactaggaaatctccacagacggcgccaaattattttactcaaaagatattgaaacttttttgaacaaatccatcaaagatgaaggggtaaatcgtagtcaaacttaattgattccagaccaagagatttcataataataaatgtgtaggagatgacgaaaatatcgacaatctcattaagattcaatattgtcttcttcctcagtccctaaggaaagaatattacaattgcttttttctgtacaagatacaagaatgaattcttcttattttccttctgtgtaaaaaatggagagaagtcttccccttgaaagcctttctgggctatatatatacaattgaaatctcttcaccctcagcgtgacttgacgcactcgggccagcagtgctttctggtcgtgattccaggcgttgctcttttcaatttgtcggatattgtggaggaaaaatgaagtggactttattgactttcattacccgattgctaaaaagggggtcgtaggcaacctggtcggggtggtcagattttgaccaatacaataatgacatgtgaaatcaaaataaatagggaaagagaggagaatgtattttattttttaaattaattaaatctataatatatgtataaattagatatgtcataaaatttagttaaattttacatttgaagtgcaaagtagaatgttctatatatatcacttggcttgaactaagaatgactatataattacttcaaacctagaggtgatgctgacgtacttgtctgtctatctatatgttcaaacgccattactaatgtcaccatttttttttttggaaacttaattttagggttgtggaaaattaatgcatagacgcagcagagaagaaatacttcaaaaatatgtgaaaccaaaggaagaatatgttacctttagttttcaaaattgttatatcctctgtgaatagccatattttgcaaaagcggtatgttacaaccaaaatccaaaatgatgtttagccataaatgatgtaatgacggccaacgtcggttggtatcacagccaaaatcaaagttgtgggtatgaagtttctatgcaaacctctcttgagtttgcaaatgattaccgagtaatggaagtggatgtcatgggtttcaatcgtgatacgctggaggttagatagtttagaaaaattttaggttatggagagaaaatttaggaaataaagtcaacttttatttttctttagagaaaaaaaaacgcgttctttaattgtgccatgtaaaatcagttattgtttaaaaacttaaaattcaggagaaaaaaatgtgtcctttacttcttctttttttaaataaatttgaaactccaacaaagttggagaattgtccaaaaaaattacatgtttcaatttaatattatgccacttgtcttaatattgtgcttttgcctctcctattatagataaatagatatttggtaatttaaacacctacatgttttttatatataaaggtaatttaaacacctccataattagtgaaattgtacaaaaattaaagcatataaagtatcttgaaatcttccatgtaggtgattccctcgttaatacgtatagtacgcgagggaatctcaataaaattaatagtaaatacacttgcgatgatttcacataaggtatgactaaaatataaaaagtcgattgtttttatcttttctcaaataaaaagagcaccaaatgcttgtaataaatgaataaataattcaaaaattcagaaatatattttcacaaactatctatctccctagcaaaaggtcttgctggactcaaagcataaagattatggttaaacatctaagttttatactaaattgaattgtgttttttaaactttttaaaatgagattacatatttagaaacacattaaaacattatataccataatctaggtatagcttaaaatatcgaaagaaatttacaattaaaacggtaggtgacacattgttttttgttttattagaaaaaacaaaaaagtttttggggtttaaggaggggaaatagcaaaatgggggatggcagcaagaaaacgacggccggaaagagaattgatggcgtgatgaaaaggaagagaaactagaaaaggtgggcccctaactaaagtttcttcaacgttggagtagggcctataagtggggtccacctctgttccttctttagagtacacgtcttttcaaaggaggaagtagaattgaaagccaataactcattctttctattctctgtcatgtccaactctccatccttttcaattaatttttctcaactctgattttaatccctccttaatattagtaaggatcactgtcaattgcattattatatagtagtatatttttatttattaagataaagccctaaatttaaacaagtttttaggaataaaagagattaattaggggggtccgggggatatggaccccatccccattgataaacaatgcattaattaatctcatgactctcaagtctcaccactagctctcatgtcatgtggtactaaaaagggttttctggtgggaaatcccaaggtctagttgtgtttttcaaccacctaaataattgaatagataattgttcaaattacaaagcatcttcttttttaacttttgaaatgttgttgcggttcgttaagagagacatttgaagtcaaagcaaaccaaaccagcttgagggagttgacaacactgcgaggttgtgttttcttgatcgagaacaataaaagtatttatgttcatatgtaagaaataagaaaaacataaacaataagaaaagtgcagatatataatttgtgtgaaggatttattatttgagaactttgcaataacgaacttcacagatttactgaagttaagtgtatgctaatcagagcgttgattttcagtttctaaggggggaaaatctatattgattcaataacatgtccatacacattctccaattgttgtcttattcgaatgttgtgggtgatttaatttgagtcgtcaatagtggagcctagagattcaaagtgctgctgtataatattaatattacttttgagagctaaatatatatgtgtttgcgactgaatattttatgagatgtgtgtgtgtgcgcgcttctattattgttgttcatcccctccctttggctagtttgagctatcatttgcagtctacaaccagcaatattaaacctattttgatcttagggtcttagcttgcctgactcaatctttgacttgttgcggctgaatgctaattagggatacctcaaattcctaaaatgctcccctagtccccgagcttggtaaataagaccgtgggaaattgttttcttccggccttgtttttatagaggggagttactcttgcgttctctctcttgggtaggtcagtttcgctctcttgtttgtaagtatatccttcttttccagctatatcaaactgtttcacctcaaaaataggttaatcagttaatcagctatacctcaatatcaaactatatggaattagtcatgtgatacaggggcggatgtagagtttgaccgtcgggttcatctgaactcaatacttccaatatgaagcataaatttatatatatatatatgaattcaataaaattacaacaaatgataggtctgaacccacaactttaaaaatataatggatttaatgctaaaaaccttaaaagttatactcataaaatttaaatcctagattctcttgtctgaagtgatactcggtgattcataagagatatttcttgcgctacttgtctctgagaagaatcgaatgtttaacttggtttacaagttggaatttgcttgcaagttagttacaattggcattgagtacatatctattattaaggggtcgtttggtagagcgtataagaataatattaaataaggtgcattaataatgtaggggttagtaatgtaggggttagtaatgcatgagttagtaatacaagcattagttatacagagattatttcttatgcattgtttggtgtggtgtattaaaaattaaaatgcattgtataatatttaagaaatttaattgtttacaaaaatgtcctccatattctttaacttaagggactttaaggataattttgtctttaatcatgctaatgtatgcattaatagcctttgtatagctaatgtcatgattttctatgcattagctatacataggataataccaaatagagtgtataactaatgcttgtattagttatacataggttgaaaaagtgtaccaaaaaagcattactaatacacaaagctaacgcatgtttgtattaactaacgcattactaacacactctaccaaacgacctctaattctcttgaaatggactatgtcatcttgttagtactaattattaacgctgttttgaggttcaagtacctgtggttaaattcttcttacttaaattaagagtaccataagaggaggggagtaggacgaagtaacagcaataaagagaacaaaagaaaacagacaagagggttaagagacagaggtgaagaagaaaaagacgtgtgagcatgcatgctcaatcactgctgtctgtctagaggcaagtccatgttcggacgaaaggaatgcctgagtctttttgctttgcaattgtagacaaaatatagtcagtggttgcatgcctagcatcctattctttattttgtacctatttgggacatttacacaagtatgtacatcaattaagtcttttccccatgcatgtggctctactccctccaataaaatccagaggcatccaaagatctatgagaacaagccaccttttaatcttgaaatgtttattagaacttcacttgtgattaaaaggtcataattaaaatttcagtgtcgcgagtttaagttttactaacgtcaagaggctatattttattttagatgttttatgtatttttcatgattggataatacgaataatgttttttttttttcgctgcaaaagaagttatgaatattgttttagtgtgtactttgactttactgttaagcaatgtaaattgctaactacgtcacattctccaacgcaaagaactaaataggtgattatgaagctttaaaatgttataaatatattatattatggatgtttatttagtatttcgttataaataagcttcttgaagaaatttattcatatgggactccgccgtaaatatgtttatctatttaatactctattggaaataagccttctaaagaagcttagcatttcggtactccgtaatgggctattaatgaaaaaccatgaaacccgacctactggttcttgtctattccctgaagtgaatgagacgaacttccaccaagctaagggtggaagaggtcgtggtcatggctgtggtcggggaagaaactctaatcatggtaataataatgcaccaaagatctctcttcaccaccagcagtggaaaaggaaggaacaaaagtatgaagcggtgcaagcaacaaatgtagaaaatgcatgatatagatgtggaggaaaatggcactggtcaaagcacctggttgagctttatcaagcctccctgaagaagacaaagaaaaatgttgaagcacattttatttctgaagataatttagaattcatgcatttggatgtagctgattacttagcactcccagaaggagaaacaagttatgtgatcggtaatgaatttatagaaacgtaaatatttaatttttgttgtttgtaatagatagtatggttatgtaattattgtacataaataaaaattatgctttgataatgatgtttactataatatattttgtttatgtcattttgaagaatatggataattttcaaattatgtttagatcaaagatcaatcatgaagatatttgtataattgatagtggaacaactcacgccatatacaaagatgagaaatatttttcttatttgcatagggaaaaaagaaaatatttttacaatttctggtaatataagtttgatagaaggctccggaagagccattatatttctatctaagggaacaaaacttagtatagacagtgcattgttctcctccaagtcccgaagaaacttgttgagttttatagatatccgttgaaatggatatcatgttaagacgatagataaaatgaatatagaatatctttatattacaaaatatatttctcgcaagaagtgcattgtagaaaagttaccaactttatcttctatcttatgttattcaaagattagtacagttgaagtacactctatcgtaaatcagaagtttactgattcaaatacttttgttctttggcatggccgtttgggccatcctggatcaataataatgagacaaattactgaaaattcgagtgaacatcaattaaagtacctgaagattcttacaaatgatgaattttcttgtgatgcttgttatcaaggcaaaatgatcattaaaccatcaccaatgaaggttggaattgaatcccctacctttttagagcgtatacatgaggatatatatggacatattcacctagcaagtggattatttaaatattttatggtcctaatagatacatcttcaagatggtctcatgtgtgcctacaatatctcgcaacctggtatttgcaaaattattagcccaaataattcgatcaagggcacaatttccagattatcctataaaggctattcaccatgataatgttcgagaattctcatctcaagcttttgatgattattgtctataagttgggatacaagctaaacatcctgtagcttatgctcatactcaaaatggccttgcagagacatttattaaatacctacaattgatagcaagactactgcttataaataaaaattgtccactattgtttggggccatgctatcttgcatgcagcatcacttatgcgtctcataccgatacattataataaatattatccataataattagtttttggtcatgaaccaaatgttgcccatctacgaatttttggatctgttgtatatatgtcagtagcaccatcacattgcagtaagataggcccccaaagaaggttaggaatatatgttgggtttgaatcaccgtctattattcactatgttgaaccattgaggggagatttatttactgctcgatttgcagattgtcggtttgataaaactaattttctacaattaagaagagagaaaaagaaaatcaaaagagattgtgtgaaaagtttcatcattatctcattttgatccacgtactcctatatgtaatcagaaggtctagaagatcatccatctacaaaatatagcaaatcaaatgccagaagtatttactgatttgaaaaggataactaagtcacatatccctgtagagaatgtgtctatccaaattactgtcccggcatgaccatctactagcatgagatctagtaaacctaaagtacacctgaagcgtggtaggcctttgggttctaaggatcgaaatcctagaaaaaaaatcaacaaatgatcaaaatgatactataaagggatctcctgaagaaatccaagatctgactagttctgagaatcctgaagaaatcaatgaacccgagactcaagtgaagaggaacttttaataagttctattggtgatgggattaatttaaatcgttctaaaatagtggtggataatatttttgcatataatgttgcacttaacattatgcaagatagtgacaaccttgaaccccgatctgtcgaataatgtggataaagatctgattggccaaaatagcaagagtgaattcaatcagaattgaagtcacttgctaaaagagatgtctttgaaccagtatcccaaacacctgctggtataaaatcaggtggtcataaatgagtttttgtgcgaaaaaaagaatgataaaaataaagtcgaaagatacaaggctcggcttgtcgcgcaaggattcacacaacgacctagagtcgattatgataacatatttacccgttatggatttcataacattttgatatctcatcaagttagcctaacgtcgaaggcttaaaatacatctaatggttatgattacaacttatctgtacgggtcacttgaaaatgaaatttacatgaaaatccatgaaggatttaaaattcctgaaacatattcaaaatctcgaaaaatgtattcaatcatattacaaagatctttgtacggtttaaaataatctgggtgcatgtggtataatcgcctcagtgaatatttactgaaagagggtgacataaatgatgttatttgtccatgtatttttataaagaaaatggattcagaatttgttatacttgctgtttatgttgataacataaatctacttggaactccaaaagtgctccaaaaggaaattaaatattttaagaaagaatttgagatgaaagatattggaaagacaaaactttatcttggtctgcaaattgaatatttagcatacgagatctttatccatcaatctgcctatacagaaagggtcttaaaacgcttttacatggacaaagtgcatccaatgattgttcgatcacttgaagtaaagaaggatctgttccgacctccagaagaggatgaggaactccttggtcccgaagtatcttatcttagtgcaattggtgcacttatgcatcttgctaatgctacaaggcctgtcatagcattttctgttaatttactagcaagatatagctcttctcctacacggagacattggaacggaattaagcatatattgcgatatttaaagagaactcttgatatggatttattttatgctaacaaagatagttgtggatcttattagttatgcatatgcaggttatttatctgacccccataaagttcgatctcaaattgggtatgtatttatatgtgtaggtactgtcatactatggcgctccataaagcaatctattattgctacttcttcaaatcatgctgagataatagctattcatgaaggaagtagcgaatgtatatggttgagatcaataattcattttattcgagaaaaatgtgatttggaatgtgagaaaagacctataattttatacgaagacaatgttgcatgcatagcccaattgaagagaggatttataaaaggagatagaacgaagcacattttactaaaattattgtacacacatgatctttagaaaaatagtaacattgatgtgcaacaaatccgttcaagtgataatccggcagatttattcactaaatctttgccaatttcaacttttgagaagatggtatacaagattggaatgcagagactcaaatatttgaaacaagattttcatgagggagagtaaaataagcactatacttttttttcttactaaggtgtttcccacatggttttccttataaggtttttaatgagacaactagctatgcgtattattaaatatgtgctctatttcctttactataattttttcctctaggattttttcctagtaaggtttaatgaggcatattatcttttaatgaacatccaaggggaagcattataaatatattatattatggatgttcatttagtactccattgtaaataagtttcctgaagaagcttattcaaatgggagtccgccgtaaatatgtttatctatttagtaccctattggaaataagccaccagaagaagcttatcctttcggtacttcgttatggataaatatcactcttggtagaagattatcaatatctggtataataaaaacttacaagcagcttgcacagcaatttacaccgcaactttctttcttttacaaatagaggagaatttagttctttatgtacatcagtttgaattcgaataatatatcaatttctctctatacttgtttttactttatcatttttattttataacataaaagataatgtataattgctttccttgttagttttgcctacttttggatttacaagctacgggcattatggacattataaacaaatacacgaacactccatttgtgatgcttatagtagattagtgggcatattagatgcttgtacagtaagggaattaaattatcaaaggttggctcatataaatatactaaaattaagaaagaaggcctttttggttgttagtgttgcgtcattaaccatatatcttcaaaatataaattttttaagaaactcggtatcaccaatttgaattttattaattttctggttattaacttaatcggtgtctcctcccttattaattttgtaaagataaagtaagaagttacgtatctccactcaaaacccacaattgtgcctactgactggtcaaaaagaggaacataagagaataacagtgaatttgaaatcatcaccaaatatacctagctagtgggacattctatattaaagtattgtcccatgctacttgtcaaattagcacatttacaaaaaggcttttacatcacagagagaaatattaaaataatgaacacaattaagattgtccaattatttttgatgaaacctgaaaggtaactatttcaacagcatacaataaactattttaattttttttttatatacatgcatacacactaacttccccaaacctcgctgtggacctcactgagtcgttattgtatatgcaatactcttcctgcaatagctacacagagaataaaaaagtcaataaacttatttctatcatcattatattgctttaaaaattaggggaaaaaatctaaataaacatacatatatatacttataaaaaggaggatgagaatgtgatgaatgaagtggcaacataatgggggaaatcaagttggtcattcaccaatcccatgaaagctgaaacttatagtgattacaatgattagctcaatatataatagtatgagcaacaaatttcaacataccatagttagtcattcccacaataaccaaaaaagaagtgattagttaaatcatactttttgtagggcaaccccattcctccttgctttttgaaaagaggaaaacatagagtttgaaagtctgagttaggttgtgttggaattaggaaaagaaaaataaaggtatggttttgaaggaggagaggatcattttcttgattcctttctcactttggtatttggtccacatatacaagagctacgaaaaagaaactttattataatgtgctgtttgttgatgtattagctgtaaatcttgcactaactaaggagcatttcattatcttttcgaaatgatgtttatataaaattataagaaatctttatatgcttagatgtttatatcaaattataagaaatcattatgtgcatcaaactgcccatttagttgtatcttcatttttttttttttcacatagttaaactatttgaatagttatctcttggtcgctgtctttttttatgtaattctttggaatttactaatttccaaacaggggcaaagctgcagcctatcaaggttggtcaattgaccaccctccgtcgaaaaattatattgtgtatataggtaaaatattagtttgtagaggtatataacacatattgaacatcctttatcgaaatttttttttgcatttttttcaagtttgaacacccttgaaaaaatttctggcttcgccactatttccaaaatgaagcattagcaagttctagtgcaaagcaacatccttgtttgtttttccaataatttatcttggctccccaaatgctgcagaaactcttctacacggaggaatatggcgttcatatattcaaataatgcaattattagatgttgtttgtcataggttgttattgttagggttatggacatgtattacgtgtactaaatttgaacaaaatgggagatctctagtttatgtttgacttgaccaattatatgtctgaaacacttgtctatataaaagctttggttttggtttttcaaaaaacagaagctccttttgtagcttctagggacaggtttcaaaaatcgattagggaaaaagtagtttgtttggattaggagaataactattgaaacaatgttcaagaaaagcattcttgttaatctcttttgtgaaacctacgtttcgttttcatttttggtttccaactatggtttgctactgcatgctacttcaaaataaatgtaaaagaaagagcaagaattaacggcagattcaatagcattggtcatgaactccaaaacaatagaaaatagagcgttgtatacttatagcctgtttgaccaaacatttaaaatcagcttattttcagaagtgtttttctcaaaatttttggtgaaaaacagtttgtgtttgactaattaatttgaagagcacttttgagcagtaattagtgtttggccaagattttgaaaaatgcttataagtgtatttttcaagaaagtgcttctcacaaaagtgttttcgaagataagctactttttctgtttctcctcaaaaaacacttttttccatctaaaagcttggccaaatatcttaatttttggccaaaaatacttttggcaacaaaaaaaatacttttggcccaaaaagagcttcgccaaacaggctattagactgtcacaccaacaacgagcacaacaaaaccttagataggcatacaattagctacttctctttaattgaaggtttaacatgtagtctctcgcaaaggtttaatggttttgtacaatttgatatattcaaatgaaatgtttctaattgagttttgtttaaatagatgagaaaaatcttactccattccctacttgaacgttgaatcttcggaattatgcatcagtgggaccaggcccaacaattctaggcccaaattttgtttatcaagttgacttacaggtccaattcaaagggtccacattgggatggggtcgggtctagaagcccataacaaattccggttatgtgagttgagaacaattcggaccaaaatcaaattaagacgagacgaattcctaatttcctactatattcattgtcgtgagcaagagagacagccacgtgccaaacgcaatttcgtaatttaaatactcatggatatcactcgcatgtcatgtgacaatttgcctaaggtccacgacttgaatgtggcctatagctttatcacatcacatatcacatatctatgtgcttgagtccaccacttctatttagttgatgaattgaccgaaacagacggtccaaccgaccatttaagacaatatataatcgcgaagaattaatatatatatatatatatatatatatatatatcaggaaaagtaaataataaattcgggggaaatatcataagtaccttgatttacaattgggaattacaaattagctatgatatgaaaaataattaaaatttagtcactttttcatataaagataaagcatgaacaccttaaaaatcaggaaagattcctgtataatatgctggagtttgaatttttttacgaattttatcatgtgctggacttccaacataatatgctggaagttaatatgcaggaacttcataatttagcatattatattggaaattttgtgtttcagctggaatttcataatgtgctggagttccaacataatatgctagaactttatacacatgagctctataatccagcatattatgctggaactttctgcatttcaactacaatagtggctatatttattaattttacaaacggtagctattttttgattaccaaccctagaactagctagcacatgctattttcacaataaagtaagccgtcaattgggtaaaaagccttttatttactattttaaaaccaatttgggcctagttggagaggtctactttcaatggattgcgcttgtatcctttgcctcatttggtgtaaaaatggcatgtggtagcaactaagtaaggtggtctttattttttatctactaattataatactcagcaaaaatagtcactactaataggaaaaagacagttttaccctttcttcaatttttatattcccaaacccttgtttttttcattcagaagagggaaaatttgagagcaaaaatttcagggcaagtttcgcgtgctcctcatctgtatcgtcctcgcatgcaaaccagctacacttaatatttctccttcttcatcttctctgtcatcttctatgcatcgaatgatcgaactggtaatttttttttgcttttatgtatttttgtttttgtatatgtgtaatcacgatcaatgttatgtcaagtatgtgtgaaatttcaaaaataatgattataaattgattcaatatcgaataagtagcgcatttttgtgaggctgttattcagaaatttttggtattgaaatgtgtttgtggttcaatcaatatatttgattatgtaaggacatctcataaaaatagtcgtacgaattcataagctaactgtgtttatgaatttttagttaactgtgttcataaaagttaaggaccaagagacattaactttcgaacttggagttcgaagttgaggattgagtgtccttaacttttgaacttgaaacttgaaacttgaagttaaagaccaagtgtccttaactttggagcttgaaagttgaagttcagggccaatagtccttagcttttcaacttgaaactataagttaaggactgcctgttcttaccttttttaatttgtaactctaaattaagggccaattgtccttaacttttgaacttataagtcaaagtccaggactaagtctttaacttttgaacttggaattcaaagttaaggaccaagtgtcctttacttttgaacttgaaacttgaagttcaggaccaagtgtccttaacttttcaacatgaaactataagttaaggactgcctgtccttaactttttaacttgaaacttgaagttaaggaccaagagtccttaacttttgaacttgaaatttgaagttcaggacatattgtccttaacttttcaacttgaaactttaagttaagaactgtctgtccttaacttttttacttaaaatttgaagttaaggaccaagtgcctcgaacttttcaagttgtaactataagtcctaatctttatgttctttttccttctttgtagtgtgataatggaaggagatcatgtgttcgagtttgatgtttggcgtaattttatgatctattggaaaggagagttacagtataaggaaacaatcaaaacttttttgtcaaacaggcaatggaagaagttgagggatggtattttcggaaaccttttctgattacaaagtgtgaagttctgtgtaaacttattcactgtgtattgctttcagaaattgtaaataatgactctgattcgatgacattcaaggtttttgaccgtgaaattaagtttacacatgaagcatttcatataattactggtttgaaatgttattcttcactagacatcaaaggtttgcatgaaaaagagaataggctttcaaaagtctattttccccggaaaggatagagttgagttgggtgatttgtttaattttattattagtcacccacatggtacaactgcatcatttgtaggcagcgatgatgatgttgtgaagttggcaacaatttattttgttgaatctattttgatggggaagcgaaagaataggaatgtgtccgagccgataatgaaaactgtagatgatgatgaactctgctcttctttcaactggggctctctttcttatgaaatgttattaaaattattgaagatttgtttgaagcccaatgagaaagagaaagagaaagacaaagataaagacaaggataactacactatacttggctttccttttgctttttgtgtttggattatggaagtattgcctatttttcaggaaaaacaatttgcgaacttccaagaatgtaattttcctcggatgttatgttatttggaaatgaaatctccacagtatgattctttgtgtaaaaatacttccataatgaaaatgtaagttaatctaattactaactatttttttgtttatttgttttagttatgaaaacttatgtttttttttgttatataatagttgtataagttgatcgaggtggcaccatttattcatattgaagaagatacagaacctattagtgtgcgagagtcaatttctcaagatcaaagctcaatgctttcttccacacaatttgatgaagtcatgcttaaggaaattgttaaagtaggatttttgtctttgaataacattagttttttatttgattatttttttgcttaagagacttttttgtttttatggtttttgatttagagattatcagagagttttaaaaaggatctgcatgctgaagttactagaataaatcagaaaatatctgtattagaaaaaaagattgagaatgaaattaaggtaatatcattaatttcagttagtctaagttcaggaccttgtgtccttaacttttgaacttgtaactcaaagttaaggactgcttgtccttaacttttgaaattgtaagtctaagttcaggaccatatgtcctgaacttttgaactttgactcaaagttaaggactgtttgtccttaacttttgaacctgcaagtcaaactcaaggactcctatccttaacttttgaacttgaaactcaaagttaaggaccaagtgtccttaatttttgaacttgaaactcaaagttatggactgcctgtccttaacttttgaacctgtaattcaaagttaaggactgcatgtccttaacttttgaacctgtaattcaaacttaaggactgcatgtcctgaacttttgaacctgcaagtcaaacttaaggactcatgtccttaacttttgaacttgaaactcaaagttaaggacatacattccttagcttttaaactttgaactcaaagtcaaggactgcttgtccttaacttttgaacctgtaattcaaacttaaggattgactgtctttaactttgagtttcaagtttaaaagtttaggacaagagtccttaagtttgacttgcaggttcaaaagttaaggacaactagtccttaacttttgaacattgaactcaaagttaaggattgtccgtccttaacttttgaacttgtaattcaaacttaagggttgtctgtccttaacttttgaacctgcaagtcaaacttaaggactcttgtccttaacttttaaacttgaaactcaaagttaaggacagtcagtccttaacttttgaactttgaactcaaagttaaggattgtctgtccttaacttttgaacctgtaattcaaacttaaggactgtccgtccttaacttttgaacctgcaagtcaaacttaaggacttctgtccttaacttttaaactttgaactcaaaagaaacaaaaaagaacgtaagcaaaaagaaattttgaaaattcagacatctcctcaaataagaataatctaaatgaatccaatttatagcaaaaacttaaaatagtcgataaacataagtgaatatatctactattctctatgctttcttgaaaatggatggactgccggagaatatatacaagttattctatcatgaccaattcttctgtaacgaccacatttgaatgttatttttgatgactcggtagctggaatatgccttttcttctgccttctacctggtggcactttgaaatctggaggtttaacaatttgtgacttaacactttctggtacaatccaagaatcagtatgtcctacaggatgtatttgtctttcatatgtttcttgaaacttgaaacttttgaagttaaggactccctgtccttaactttttaacttggaactctaagttaaggaccaagtgtccttaactactcaacatgcaagtcaaagttcaggatgaagtgtccttaactattgaacttgatacttaaagttaaggactacctgtgtttaactttttaacttataactataagttaaggaccaagtgtccttaaatatttaacatgtaagtcaaagtttaggaccaagtgtcctgaacttttcaacttgaaactcaaacttcaggtccaagtgtcctcaactttttcaaaacaatttgcaaatctatgacagtatgaccttaatatacagaagaacaacaacaaagttaaggacacaatgtccttaactttttcaattcaatttgcaaaatcaggacactatgtcctcaatattatgtgctcactttttatagaattatcacaggatgtgatgtccttaaccttatcaatccagaaattcaaaaaaacaaaaaaatcaaatttctacttactgtataaaaattaatagaaatcggaaaaaatataactatgtcgaaataaaaatcaatagaaacacataaaagtataacttattgtaaatttatgtcgatttttggacgagaaggttaaattctatagtttgaaatcagaagagaatcttttgcaattctatactttgaaattcgacgattatagtgaagtagttacgtgcgttgttgctactgctgattgttaataaaagcgtaggtataagttatagcagaagagtattttcatccaatcaggtataagtttattaaaccagtggctaaagcctaaagacatttaaatcactggctttaaaataaagatatgtgctattagtgactatttgtgcacatcgccctcatttggtccaatggacactttgaattttggggaatcttcattgtatatagttgccataaaaagcaatagtcaataaatatatattttatatataaccaatatatatttttggaattttacctcctatagcaaaagttgatgtcttatttattttaaataaataccattttaaaaaattatattccatagctactttttcatttttatagccaaatatctatttgtggtcacctcttacacttaagccataaaatacgctttatattatttttctatctcattctttcagatttttctccaacctctctctctctcagcgccaattctcacacagcaagagattgaaacagaatccgccatgaaagaaatcgaagaagcatcaaaaggttcatcgttatttcccgttttcccccaatctacactaattgggatgatcaaagtagtagaacattaatttctgagaccgagtccattgcgtgccgaccaaatccaagtttagggcaggggatgtcattcaacgattttgacaagttttttaaagagttgcctcatgtggacgaccttcttcacctttatgcagatgaatatcgttctaattaggaatttttactttgaacaaagacgacggaatttggggctgagcaacttgaagagtatgtttcctttttttctctctcgttgtattgcaatgtatcttgttgtattctatgtatttcattgtattcattattttcttttttcattgtatttcaatgtatctcgttgtattccatgtatttcattgtattcactgtctcgctatattccatcaatgtattcatatatattttttaattaatataatttatgtattcagatttatagttgagtttgttgagttatactaggagtttattgtgttaattgattcactttccgtttaaaaacaactgaatagaccatgaattgcgctatttacgttgttgtattcataaatacatatcgtgaatacagtcgaatacaataatctgtctagctgtaattccctgtttcacgccgtaaatacagtcgaatacaataatctgtctcgctgtaattccctgattcacgccgagaaatgctactgtattcatgaatgcagtagcttaaatacatcgaatacactctagaaaacctggaaacatagctataggaagtaatatagtaaatgatagctacaactagctaataatcactaaaacatagtaatttctgaaagtttctctatatttttgtatatttaactaggaactgtaattatttttagacgaccgaccaaataaaatcccattttataaattaaaaaagctctgacatttcagcaagtcgcatttggttattgtctaacattgatctcttaagacttgttaagaaccatatctaccctcttgtgtaaagtaacctttttcgaatatttcactcaacacacattttcacttccttatcctttgctgatatgacttgatttgtcgtagcatttaggaagtcacaacaggatcgaacggtaattttttttaattattattattcgataatatttatacgttgcgtataataataaatagatagttttaagaactaaacatagtttttcctttttgatgaagttgacttttgtcctttttacttgattattataacttacgcaaatgtaccattataaaattatcaaaagcaatatgaatattgccaatgtacgcacaatttagatcgtaaaagttataatttcacccttagagattttaaaataggaatactcctctttacttgattccgaccatccttagtgcatactttactaactgggtttattaaaaaacagtaatcatctgctttaaatcattagccgatatcacacaccaactctaatatactgttgaccgttagttagtctagtagcgaggaaaaaggtcgagaaaaaaaagtcaaaaatgggcacatcaaacttaaaactgaatacaggtccacgtctccttcggtagagttacgtcccaacaacaccacgacgcgctcgaaccctttgatgtaaccgacacgtcattctccgtgctaaaatagccgtttacgcttcctttggactcgtcgttattaatttcacaaccaaccaaccaaccatggctgccgccgtgaccgagaaaattatgtcgccgtcgcctccgccctcgcaacacatgcatctgtcgccttccacttcccggcgtggccttgacgccgcctccgatactgatgctctcgatcgccgcccttcccttgatctttcctctgcttcttcccctagcccaacacgattatctgatgctcaggttaccttcttttaaattaatttgttcaattaatttctactcgatattgcattaggagtctgaattatgaattaaattccacaattttagtgtatactatatgaattttatgggtgatcatagcttcaaagaaagtttctactctggtttattgttgcatgcaaatgaagaactcttttacttttcaagagtttgtcacaatcaactaactaaatttaaacaaaattggagttgtggttggtgaatgatttgactgtgtgtggctgattgcaacaattatcaattttgtgacagaatcagctgtttgtgaagagtgaagagtatcgacaactgttccgtttaccgcccgatgaagtgagtatccgtctcttatgtgttaatttctctatgaatttgtttgcattgaattgtggcagtttacttatggttatatatatatgctattttgtgattcaccaggggcggatgtagtgaagaagctacggttcattcaatcttagtagctttggcttaaaccctttatatgtgttaaaaaacccattaaataagtaaatataatagatttcgagcccagcaattggactggatgtagtagaattccgaatccgaacccgaacccataaagtttaaatctggtgaattcaccagggtatactctgacctttttcccttggtattttaatgtctttagaagtgtcagtatttctgattatcatttcttgtttgaggcttaatcctgtaagacaacaaacaaattgcaaaactagtaccaaatatcaaagttctttttttggcgtggttatggaaataacttctccggctatgtgcaaacacatctggtcccacgttggaacaaagaaagagcattgtagtcagagaagttgttttgactcgggataatcttaggaagaggggaatgccactttgttcaagatgctatttgtatgggtaggatgaagagacaatcaatatctattttcacactgcaggattactagtcaactttggtatttgttcatcaacattagaggcattagatggccaatgccaggtagaccttctgatgtgttgacaagctggaccaaagaaggaactgcagctgaaacaaagacaggtggaaaattgtctctggtggacagtatggaaagagaggagttcgagatattttgaagataggagcagtttcttacagctgattaagattgattgtgttcctctttttagtttttggcgtaaatctgaatgtatagatgatcctgaggctctcctatatgcgctagattccttgtaagaagatcaaggttttattttggtttttaatttggtgccatggtttaacaatttattttccaccacaacctttgtgctgatgtctctctcgctgtctctctctctatatatattaaagggcagtccagtgcacaaggcattccgcgtttacgcaacatccggaaaaaggccgcacccaaaatagacaacctaccttagtgcaagcattagtggttgcctcgatgggtcgaacccgtaacctataggtcacacggaaataaccttaccattgctccaaggttccctttctctctctctctatatagaatgttgccttctccaaaatgaaaaggagcgttgcagtaggttgacaaccaatgtaaattaatgtagaactagtctgactatgatcaaacctctagagcggaatggtacaaaagatttgtatagctgactccaaccaatttagggttgaggcataaatgggatatgttcctgtttgagatgctctacaagcttaagaaaacattaggttgttcacttaagcagatgcttcctagtgcttgttagcaaagaaattatctagaaccgtttactcaaaaagtacttagccttcgtgtgtccaagtcataccttgatttgcaccccatagtgtgtcgttctgccaagttcaatttttgtacatcttatcttcatgtccatgtttcgaaacaggaatagataatgtgatctttagatccttttcttttacatctcttcacttaagttgttgattgagcatgtcttgtggaatctttatttcatctgtatgaagaatatagttccacctcttctttcccgtggctgaatgcagctttcaaatctgcatgctaacagatattttatgtttatgttctgttggcctgtataaattctttacaggtcctggttcaagattttaactgtgcgctgcaagagagttttctacttcaggtaaacttgaactgtatgatgtttcacatctatccgcattaaaaagatgatattatacatgtatagttgaacttgtggcttcttgaaccaccctaatttctaatatgtaacattttcccttcctttctaatttgtttacacgcttttgtgcgttggttaatgttttactgttgttacagggtcatatgtacctctttggccattatatttgcttttattccaacctcttcggctttgagacaaaggtttggtgttctgtttttttttacccttcaataaattcaccttttataaagcctatagttgattgagataggttttcactactgataaggtgttcttctctgtacacaaatatagctgagattttgtctgtttcgattatgcaattattttggaattgctattaacaaaatatttactagattcacggggtcaggatagaggttatgtgcctgcatgagaaggaaaatgcatattttgatttgtttggatttgttttcatagcactgcttgattgagaaggcttcatgtgattcaaggtagaaagaagaggaagggaaggttctatttacttagaactagatatgacaatttgtctgtacaaggtgcttacgtgctacccacctgaaatgggtgcattagagaaagtaaacattccaagtaacactaggaagggtttggctcacatgtttgatgtttggactgatacaacaggatataggttatagaagggatataggcaaggatggtaatgatacgacctctcatgtgcggtgggatgtcatatggaagagagattcgaaaagcttatagtggaatgctctattatcattccatcttaagcagtttgttttatatgagagttttgtgaattgaaggcgatgaatatttgaacaacaaaggaccctctgtttcctatgtcttcctttttatccccccccccccccccccaattctttgttctggtgccatatacagatttcctttttttatttgtcgtgttgctttcctgcttggcaactgttgacatattttagtctcgatacataaaattcttgctgctattgtttgcaataggagggtacaccatcatgaggtcctaagaatgtgtttaaaggattgctttgtctgtatttcattgtttggccttgttatttaagttttaagactgactaataagctccattcaatatttaccaagaattatactgcatgacatctgaggatagcttgtttcctttttttttttggataagtaaaaagggaatcaaggaaaatatagtaagataaataagaaagtttctctttctcatctgttttgctatacatttttaccttgatgtaaattaagttatcaatatccatcttccagaaaataatacattttcatgagatcacgtcagtacgaagagctaaagctgcggccatattcccgacagcaatagaaatagtagccggagaaaagaaggtaatgtcctggatttgtgatgccatttataatgccatatgttttttttaaaacatgatgtatgccatgttaatgctatatgcctgttctcctttcagattaatacttcctcggcgtagtcttgacttgccttctgttaatgcagtacttttttacatctttcctgtcccgagatgaagcttttaagcttatcaatgatggttggctacaacacaatggtgcagcggaagagtctacagatctggtgtgtcgtcacttacatagcttgggaatttataaaatgtgtttaggcttgttgcaatatggagcaccccccccaccccccaaaaaaaaaaaaaaattctattttttggttaatgctgataaattatgaatactccgtttgtgctattttggttagtcagtaatcagtcgctctccgtgtaacctaacattgatgcattccccagttccttgaaaccttgttatgttacttgttattttcaactctaaaggcaagtgtgaaaaaacataattttttccagcataaatttgaaaagaaagatgccgcagcagtgtaagggtattagtattgaatgttccaagtagaatctctattacagttttgactttgctttttggatttatttccttcacttcccttttagtcgtcatctgtgcggaatcttggtattggtggtacatcagctacataagtaaagggaaggatttagtcatttagcaacctaagtaagtggaagatttagattttagacccttcaaagatattcttctttgtggaaatggaacatggtatgcaattaaaagttaagcaatgccaagaaggcggcgctttttactagaaaatctaatatataacttgcattctttaaatgaaaacacctgatagtaaaacggatggaatctacccttcattgccaaagacgttattttggtattacgaatagttgttcccttaatcgccaaccaagcccatataatttggaggcttctgtgcctcacttcattgcaatgggttgactcctggataagttgtgtgggcaaagtctcagacatgtgccatgtgctacttcactgacatcttaaatttggttgtgaaagcattggtgaccgtgtcctttcatctcccttagcctgttttctcaccataatggctctgcataagttacgtgaaaatttggacattctacctcttggttttcttctattcatttttctcttattttgcaaagagaagtttgagaattctctttatattcatcttccaagaaatatctgtttcaatcctgaaaatatttcttgctgatgcttttattttttttgggccttctctttgcagttctgactgtgtttaactttgctttgacgtcaggagccaaaatctgatctaaacagtcaagatagtggaataccagaaggaacagatagtttcaggcaggctatggaaggggtagaatccctcgaaaggtatctagagtcaagttaggaattatcttcccttgcactggagttatttcagtctgttaattcatgtgaccaggaataaggatgatacagtacaggaagactcaaagcccttggccaatggcgaatttgaaattgtatcaaagcctttaggattgcagcgcaatgtggaagaaaaagcagttattgttcaaagtactgattgctcctcttctgggaggtcctcagctttgaagcaggaggattcagatgcacctcggggtcagtcaaatgtccctttgggctttttgttatgtgcttcttcattcttcaagtgtgttaaatgattttctccattcaattaattaacaatctctggtttctagtatttaaagaaaaattgcttattcgttggctgatatgttgaagtcatgtgcattcttttgttgcaagatgttagatacttatgtgtaaataatcttagtcctatatgtagtaggagcagaatacgttctagtcccatatgtagtaggagtagaatatgtcctagtcccatatgtactaggagtagaatatgtattatatatagggctcattgtatcattgttaataaatagatttttctcccatgcattctcacatggtatcagagcttagtgagaaaattattgttatgcgtcattccagcgacatccgggaagaaagatctcatagccgtgcaattttccggcaacttagtcttgttccagggttcatcactgctacagatacgaaacccttgtgcgaccaaaccctagaaattcccgtcctatctgaacagaaaagtcagtcaccgtgtgtttttccgattgactactcaagattgatttgcgttatctcctcatcggtaagtgtttgtgcaaaaaccaacactaccatcttgttcgaaaaagttaggcgacaaaacccagccaatcgctctgacagaaagtcacgcgccgccagaactagggttccgtcgagctacagtaacttttccggtgcgtgtaagccattctggccactttttgacaaaacttcttcaggacaacttactcgtctggtgattcgagcctacgcatataaattacatcaaattctgacaacttttattttttccagcgtaaacagtgcacttcaggcatgaacagtgatttcccggtgtgaatagtaatttctagaaaagttctgttttctggtggtgttttagaacctattttgtagtgtggaattcggcgtagtctcaatattttcaaatttttccggcaacctttcggccaacttctgtttatcagcaaccacttggttttgttgcttagggggagtcgagtggccttgtatgtcgaataatcaacttgcagatattttcaccaagtctctcacgagtcctcgtattagttacatatgtaacaagttcggtacgtatgtatgcacctgcttgagggggagttttagatagttatgtgtaaatagtacgagtcctatatgtagtaggagtagagtatgagcccgtttggcttggctgatttattgtagctgataagcattagatgctgaaaaacacttttaagtgctggagctgatttaaaaaataagcagttatgtgtttggataaaagtgctgaaattaataattagcagctgaagaactgagtatacgaagatttttattttaaaaagaagtattttaggaatagaatagtaaatattttggtcaaacctaaagcgcttataagttgaaatttgataagttgggggagaccaacttatgacatttggcttatttttggtttataagcacttaatttataagtacttttaattttaccaaacgcgtagataagccaaaaagtgtttataagtcagtttgaccagcttataagcttagccaaacaccctctatgtcctagtcccatatgttgtaggagtagaatatgtattatatatagggctcattgtatcattgtcaataaatagattttctcccgtgcattctcacacaagaagtatgtgctcatgttgcgttgcctgtatgtttacttcttcttcataatactgagaattgcagtgtcactagtctaaaacatgaaacggaattagagctaaatgtaatgcgcaaagctaaatctcatgtaactctcccaaatgtgctaacgtgtaacaagggaaaaggcaggaagaatgaattaaactacccggtgcatttaggaccttcaagttggaaagtgctgtcatttttatcttccacaccttcccagataacatatagtgtgcccttatcttggtctggttttctaatcctatttctttgcctctatctgctaatatgggattaagctgggtttgttgttgttgttagtccgctaatatggtatcagacgtgcacatcatgaagtgagagaactgtctgctaataaggtatcagacgtgcacatcacgaagtgagagacagttactaggacttatgagcaggtttactttcctcgtactagacagatgttatctggtattctcctatggggtgggtgtctattctcagagttctgaccacaagttaatgctcaagttctgtttgatagatgcgtactttcagccagaaacaagattctctttggtacttgtatccaataggttctaaagctattaaagcaattgtttcttggattccaccagcaaaactttccttttcttttttatattctgtgtttgaaattctattcagttcctgatttacctaaactttgcattatttgacatgcagtccctgaatgctttacacttgttgcagaggccaagtttccggtgatataactttatctttttccctagttctttcatttgttctgaatctctagttttcttcatgatggatgtgtaattaatcttagactgttatttgaacttaatatttgaggtgcaggttacggttgagaagttctttgaactcttcatttcagatgacggtattgcttttcaggagtcattccgtagaaaatgtggtgataaaggtgacagtattcatggattttgctgacgtggatatatttcagcgcattctgtcagttagatttagaagcaatggatcacaatgaactgataagtaattatgtggttaaccaaaagttttccgtcctttttccccagattttaagtgcacacagtggcgtcctcatgaagaacttgggcactctcgtaattggtcgtttcagcatcctattaaattctatttaggtgtgactacacctctatatcaacaatttaatttcaaacatgacttgagcactctcaagtgaatcaagatttatttatttttgactaatttatggtttgattaggtgcaaaatttggtggctgccatgaggtacagaactatcgtttttatagaaacaggtaataacttctactatggcgctactatagttcactgattttgcttttttttttttttaagagatactggcactttaagttctctttgatgctgtcattctctctgctgctccatgcgttagcttgtctcttacatgataaagttctttgcataacatcatttttgtggttacatgtgagtttctccgaaagcaaaagcttttgagtcaatgtaattcaatgaccggagagcatagatttgtggaaagttgtctagcttacgtgctaagaatacaggattccctaatttcaatgcacaatgtatgctgcaattttctcatcatatcaataacaattaacaatttgctgaccatatgattcttctaaggtctatcatcaatatatttaaaaaaacctttcatcttttcctttttggtaactttagctttttgtcatataaaagcatatgtaaagcacataaaagataatgttttctcacagccgatatatgatatagatgtccgagaatcatattggaaattttttttagtggatcacgaagcagaatcttaataatttggttggcttaataatttgattgtgcgccaggttccgcctacagagaatctattcataggagaggatttcaatggtcatattggggcgactgcaggtggttatggcgaggtgcatggagactttggttttggggagaggaacggaggaggtacattgctgttggacttcgctgaggcttttgggttggtgattgcaaactctagatttccaaaaaggaaagagcatttgattacttttcaaaatgcggtagtggagacctagattgactatctccttcttaggaggtgtgacagcgggttgtgcaaggactgcaaggtgattccaagtgagacactctcgtcgcagcatagacttttggtgctagatgttggtattaggttaaagaggaggaaaaggtctgctcgggaaaaactaagaatcaggtggggagccttgactaaggataaaacccaagagttggagtgccggttgtcagctatgggagcttggaggagcagtggggatgcgaacactatgtggtcagcgacagcagactgcataagggagtctgcgagagaggtgttaggggtctcgatcggtgtctctagtaggcataaaagagactggtggtggaatgaagtggtccaaggtaaagtggaagcgaaaaaggcggcatacctgaagttagttgggagattaggtgagtaggagaggcgagcgtgcatggagagttataaggtagctaggaaggaagctaaaatgtcggtcacggaggctaagactgcggcttattgtcgcatgtacgaggaactgggggaaaaaggcggggagaagaagttattccggctggccaagttgagagagaggaaggctcgagatttggaccaagtgagatgcatcaaggatgaagatggtagagtagtagtggaagatgcccagattaagaggagatggcagacttacttttataaacttctttacgaaaaaggggatcatgatattgtgctaggcgaattggagcattccaaaagtcaccgtgacttcgggcactgcaggtgtatcgaggtcgaggaggccgtgggggctatgcgtaagatgagtaggggcagagcgaccgggccagacgaaattccagtggaattttggaagtgtgtaggaagagcaggtgtggagtggttgactgggttgtttaatgttattttttaggccaagaggatgctggatgagtgcaggtggagtacggtggttccattgtataagaacaaaggtgatatccagagttgtaacaactataggggtatcaaattactgagtcataccatgaaagtatgggagagggtggttgaagcgagggtgaggatgacaacgtctgtatccgacaaccagttcgggttcatgcctgaccgttccaccacagaagctatacaccttgttaggaggttggtggaactgtacagagagagaaagaaggatctgcacatggtgtttattgacctagagaaaacgtatgacaaggttcctagagaagttctccggagatgcttggaggcaaaaggtgtgtcggttccttatattatggcaattaaggacatgtatgatgggctaagacctgggttaggacagtaggaggcgactctgagcattttccggttgaaatggggctacaccaaggctctgcgctcagttcattcttatttgccctggtgatggatgcgataacaaaccatattcaaggggaagtgccatagtgcatgctattcgtcgatgacatagttctgattgatgagtcacgagccggtgttaacgagagattggaagtttggagacagactcttgagtctaagggtttcaagctaagcagaacgaagatagaatacctcgagtgtaagttaagcgctgagccgggggaagtggacgtcgatgtgaggcttgagtcacaggttatcccaagtagaggcagcttcaagtaccttggttcggttatccacgggggaggagagatctacgaggatatcacacaccgtattggggtaggatggatgaagtggaggttagcatctggagtattgtgtgacaagagagtgccaacgatactcaaaggtaagttctacaaagcggtggttagaccggccatgatgtatggggctgagtgttggcttgctaagaactcacatattcaaaagatgaaagtagcagaaatgaggatgttgaggtggatgtgcgggcatactaggatggataagattaagaatgatattcaggagaaggtgcacgtggctcccattaaggacaagatgcgggaagcgaggctcagatggtttggcatgtacaaaagagaagcccagatgctccagtaaggaggtgtgggcggctggttgtgaaaggcacgagaagaggtagagggcggcctaagaagtattggggagaggtgatcaggcaggatgtggcgagacttcagatttccgaggacatgacacttgataagatgtggaggtcgagtattaaagttgtaggctgggaggtagttgagtcttgcgttactttgtacctttgtgagcctagtctggtagggttttgtctaagaacgctaggggcaacgtcgtgtcttactattttatttttcgacgttggatccatttactagccaccgtttttggtttgcatttttcttctgcattttatgttcctattttttctatgatctccgtgatgaatctaatatcctctccttttgtcttctttttattatcttgagccgagggtctttcggaaacagcctctctaccccttcggggtaggggtaaggtctgcgtacacactaccctccccagaccccacttgtgggattttactggattgttgttgtttgtttgcttaatttagtgcctgaagtagcaagtatgttagtaatttgggtggcttaatttagtgtcccagtagcaactatgtcatatttcaaatgatcatgttaattcggaacttcttaggcgattaactgagttaacagtggtttaacatctaacatcaactcttgctagcactcctggctatctccatcctctggatgaggtctctgccttcaattaaggggtggttggacaagcataaggtttggcaatctaccttttcagaattttacatggttgtggagaggaattaatgatgtacggacaaacttgtaatagcttttgaggccctaagttgcagcctaaaagcgttaataattggtagacagaagttgaaaggggaactgtttgagcactaagttaagtgacgagagaatgaattaaacgaatgccgtaaagtgatatatggacaaacacacgtagtagtttttatatgtgctctaagttactgataaaaagactgaaggaagttaaaacaatagatgtttcgagggctctgggttaagtgataagaaaattgaataaatgacgaagaaaatgtcacttcctgcatggtagatcttatgcgtcaaagtacgtctaaattgacgctacatgtgcaaaaatatggaagaggaatagtgggaagggggcctcatatagggaaaggaacaggagaacgtttgaagaaaagcagaggaaggttctgcaactagaaatgattatgctgatagattttgtagctaaagactcctttatgtagattcccttccatttgtgcaggtgagcttttctttcttgccataaagtttattttgttgtaggagaaagcattgcatcacacaatgtgaaggaagcaaatttatctgaaaaattctttgatctttctattaaaaaaattatctgaaatttctgtattagctgagcagtctgatatgcaatgatatctttgtagatgctagaacttcaaaaggatgtttaaaaccaactctaacaactaatattacccaaactctacatagacaaccttaaacctttcactataaattttatgctcggtgctgtaacaactaataattaccaaattatcgtagttacagaaatatccacaatactaaaagcttgaaatatagaaagtacaataaaaagattaattgaaaaggtttcgaagtctcagtttgtatgcatgtgaatacacacagataccaagtattgatgtaagaagacatttaaactgaagaatggaagataggaaatctgatccaaagtctgtatctcaagaggagtgaatatatagatctttcgtattggttttgagaacatttgttgtgaaatgtggcccgacatcaacaaaagacaatagctgaaatgtggtctcctcaaggatggggacttgtatttaggagaatgttgaatgattgggaggtgactagattcactgatttctacaaacatctggaaggcttcacaggattacagaatggggtggatacactaatatggcagggacacagcagtggcattttaaggtgaatgcatcatacaagattctgagctaaactgacatgcagattatcagttggccttggaagcacatgtggaaaatcaagatcccctaaggtggcctggttcccatggttactagcaaaggaggctgttttgaccaagacaatcttatcaagagagggatgccactatgctcaagatgttatctatggagaagatgttgagacaattagccatctatttttacattgcaagataactgaccagctatgtaagatttttattaatctcaaggcatattttggacaatgcctagcaagatgactgaagttctatttaattgggatggagctggagttggatcaagagacagagatagatggaagactgtcccagcatgtatttggtggacaatctggaaagagagttccagatgttttgaggatagcagcaattcagtgcagaagatcaaactcgattgtgttttgctcttttacttttggtgtaaacaaagtgttagctgaaacgtaaaagaaagaacacaagatttaacgtggttcggatcaaaataatcctacgtccaccagagaacaattgcccttttaatattaacaaaggaaggggagatttcccagttacacttaagagaatttctctcttagctctctactcactacaatgtattgtattattttgggatggtttctacaaatgaaggagtacatctatttatagaggtaaagacctccttttgatgtcattggtgacatcaaactacctcctcttgatgtcatgggtgacatcaaaggaggaagcttcctcctagcatccacactaactctttccaccaactcttccaattggcatgccattgttgactaaacataaaccaacaccttcaatctccaccttgatttgcgtttcgagcgtgcgtgtgaacaactctggccaaaacttctaagcttactgggcaacccgttgtaagaaacaagaagaatcaaaccattgttgaacataccacctccacctaacaacttttctcttcggagttgcatcagttgatgcacacccccgccaagtccttgcagtgtgcaaacttagcgagcgggactatcttggtcaacatgtctgcagcattatcgtctgtgataaccttcacgaccttgatagttccctcatcaataacatctcgaataaaatgaaatctgacatcaatgtgtttagtgcgctcatgaaatctttgatttttcattagatgaatagcactctgactatcacatctaagagttgattccagctgaaccaaactcaattccgctactaaacttttcaaccagataacttcctttaccgcctccgctgctgccatgtattctgcttctgtcgtagacaaagcgacaatcgactgcagagtcgacttccaactgacggcactgccaacgagggtaaagatgtatccagtcgtggaccttcttctgtcaagatctcctgcatagtcagaatccacataaccgagaattgaaatacctgtaccactttttcgaaaggtaagaccaacaccagaagctcctttgagatatctcaatatccacttgacagcttcccaatgcctctttcctgggttggacatgtatctacttaccacacttacagattgagcaatatctggacgtgtgcataccataacatacataatactaccacctgcactggcataaggaatctttgacatatgctccacctcatcctcggactgaggcatttgtgactctgaaagtttaaaatgaggagctaatggtgtacttacaggcttgcacgtttgcatattgaatctctcgagaaccctttcaatatacctcttctgagaaagatgtacaacatcgtcttctcttgaaatctccataccaaggattttctttgcagctcctaaatccttcatgtcaaattccttactcaacagtttcttcaaagcatttatctctgtaatgttgttagcagcaataagcatatcatcaacatacaaaagtaaataaatcattgagttaccagacatattcttgtgatacacacagctatcaaatgcactccttgagaattcatgtgtagtcatgaatgcatcaaacctcttgtaccactgtctaggggattacttcaaaccatataaagacttctttagttggcatacgtgatcttcttttccctcagctaggaaaccttcaggttgatccatatagattgtctcttctagatcaccgtgtaagaaagcagttttgacatcaagctgttgaagctccaagtcaaattgtgcaaccaatgctagtagcacgcgaattgagctatgcttcacgaccggagagaaaatctcattgtagtcaattccctccttttggctgaaaccttttgcaaccaatctcgccttgaacctagcatcttccacttcaggagttccctctttctttcggtagacccacttgcatccaactgtcctcttccccttttgtcttttcactaagacccatgtctgattcttgtgaagagactccatctcttcagtcatggctaaccgccattgtgcggcattcttgcaagaagttgcttcaatatacaaggagggctccaaatctttaatctcttcttgtgcagctacgaacgcatatgcaatcaagtttgcttgatttataaggcattccggttctcgtgtctgcctcttctccctccccttcgcaattgtgtatggttcattgacagcaagttcttcaaggcctacatcttctgactcatctttaacctgagtctcttgatccttttccttggcaagctccaccggaagctccacctgctcgttgttcttgtttcctgaaaactccacggaaactttacgaggatcaagtatagaggattcatcgaaggtgacatctctactaactataaatttgagtaaagacaaacaccaaagtttgtacccttttactccatccacataccctacgaatatggccttcttagcccttggttcaagctttccttcattaacgtgataataagctggacacccaaatactcgtaagtatgaatagttagagggttcacctgaccatacctcattcggagtcttaaagtcaattgccgatgctggagatcgattgacaatatgagcagcagtgtgaactgcttcagcccaaaatacttcggacattttgacttgtaggagcatacaacgagccttttcaagaagagttctgttcattctctcggcaactccattctgctgtggggtatgcctgacagtcctatgtcttgagatcccatgaaccttgcagaattcattaaactctttattgcaaaactccaagccattgtctgtgcgaagatacttgattttccgctccatttgattttcaaccaaaatcttccactctttaaatgcttcaaaagcatcactttttgccttcaaaaaatacacccaaacctttcgtgagaaatcatcaataaaaatgagaagatacctctttccgcccttcgatggaagtttagaaggaccccataaatttgaatggatgtagtctagcactcctcttgtcttgtgtttgccagtgctgaagctgaccttcttctgcttccctagaacgcagtgctcacagatgtcaagcgtgcttatcttctcaccttccaaaagtttacgattgctcaacatctccagtccacgtgcgctcatatgacccagtctcatgtgccatagtcttaccttgtcatcattagataactgcactgtagatgcatttgcagagccaacaatggtgcttccggccaatgtgtaaaggccgttctccagcttgcctttcagcatgactaaagaacctttagtcaccttcatagttcctgcttcgctcatgtacctggagccttgttcatccagagtacccaaggagataaaattcttcttcagatcaggaacatgacggacttgtgtaatagtcctcatgattccatcatggcagcgaacccgaactgagccaatgtcaactattgcacaagttgcattattgcccattactacggttcctccacttttctcgtagctgctaaactagtcttttcggaacgtcatatgcagagtacaagcagagtctaacacccatttgttttcataactattattattattacacgatgttgttagtacataatcattatcaaaattatgtacctgttcaactgtagatgcactcgccttttccttggactttgacattgggcaatctcgttcaaagtgccccttcttgccacaaccccaacactctgtattcttcttgttcacacgagactttgatctgtgctttaatttgctctttccctattggctagtccggcctcttacaaagaggccacttgcctggtcatctctatctccttcaatgtgcctccgcacatcactagagttaagtgcctgccgcacttgctcaagcttgataggctccttgctatacatcattgaattctcaatatcacgatatcctgaagtcaatgaaaatagcaaagcacatgcaagcgtctcctcctcccttttaattcctgcaatctgtaagtccatgacaagtttattaaacgcatctaaatgatcttgtaacgaaatacctgaccccatcttaaatgtgtgaagacgccgttgtaacaacattcttgttgtcactgatcggtcttggtataacccttctagcttttcccacaactgtttggccgtctcttcggtacccgtactcacttcacaaagcacgttaggtgcaagggatagttggattgcactcaatgcatccccttcaatcttctccttgtcgggggctgatatatccgtaggatactttccgtcaatagcatggattgaaccttccctccgcagtaacgccatcatctggatgttccagatattgaagttgttgcgtccattgaatctatcaatttcaaacttcatggaactcatatttgcttgttcttcctccttggatcgttaaagaatcctgtcgctctgataccaattgttagctgaaacgtaaaagaaagaacacaagatttaacgtggttcggatcaaaataatcctacgtccaccagagaacaattgcccttttaatattaacaaaggaaggggagatttcccaattacacttaagagaatttctctcttaactctctactcactacaatgtattgtattattttgggatggtttctacaaatgaaggagtacatctatttatagaggtaaagacctcctcttgatgtcatgggtgacatcaaaggaggaagcttcctcctagcatccacaccaactttttccaccaactcttccaattggcatgccattgttgactaaacataaaccaacaccttcacaaagttacccagaagatactgtttcaatcctagatgtcttagattcttgctaggactgcagaatagtcttttcttctccgtcgctgacttgttaatattgtctcagtacaagccatgtactgattctatatatatatatatatatatatatatatatatatatatatatatatatgttaccatctcaaaaaaataaaatataattggacacgtgctgtacgaggcttctctagtatattaagttctcataggaagcaagatatatagcttggatactttgtatatagagatattgtggacatggacaacacagtaattggtagaacaaaggagtagttgattatagttgggcccctgtcctattttctgaatgaggatcctatctagctcatgaagcccatcaatagttgtgctctttgactatagcctccatagcggcatcctcactctttttatggtggaacaccttattagtcatactttaaggccaaggatgctaagcagatcttctattctgtcggattccactagtggcattggatgacctttgctaatagggccctatacatatatgtggaaggttatgctgttgataaattaaatctgcaagtgtgaatcatctgaacaaaaatctaaattggggctttactcgtctttatatagatatacttttaaggactgttagtttgatagttaaatagtatagtaaataactctaatcccatatgtattaggagtaggaaatgtatgatatatatataggactcattgtatcattgtcaatattgatcaagaatattttctcccgtgctttctcacatggtatcagagctttggtgagaatatatcgctgtgcgtcattccagcgatatccgggaagaaagacctcagtcaccgtgagattttccggtgacctaagtgactatttgcgtcaaagccactaattatcagtgttgtgcaaaatccaacaccacctgaaaacactcacctacgcgcctgccggagttctgccggtggcgacgcgtctgtcccacgcgctggcgcatgagggctgttccggctagaatttcaaaaaatttcttttggacagtgtaatagccttgcttttccgagcctacccatcaagtttacatcagattccgacaacttttttattttccggcgagctacagtgtttccggtgaacagtaacagtgaaacaatgatttccaaacaattttctgacctttccggcgtgaacattataatgtcattcttattagaagccttagactcacaattcgttggatcaaatgcattaaatccaatccagatggtttctttacccgattatattgagttccttcagtacaaagcacgtaaacagacatcttcaggattagcctttgttgttccaacaaatagtagcatgactggtgtgtcccaatcttcaccttctgagtcttgggtcattgattcaggtgcatctgatcatatttctggtaacaaatctcttttcactagtatctcatattctcaatctcttccaacagtcacaatggccaatgggtctcaagccatggcaactacaataggtcaagcaagtccacttccttccttacctttagactcagttctttatgttcctggtagtccttttaatctcatagccgttagtcgcttagccaaatcacttaaatctgatgttttatttcttgatgaccttgtttttatacaggaacgcagacagggcggatcattggtatcggacgtgaatcaaatggactttattaccttatccttgcaaaatcacatggactcgcatcttgtcttcctccaataatttctcccgttactgattcaccagatttattacattaacggttaggacatccagtttgttaaaactttagaaaatggtacctggcttatctcacttgtccactctagagtgtgagtcgtgtcagatcggtaagcatacccgctcccatttcccgcgacgtcttgataatcgagcagagtcaccttttactttagtccattcagatatttggggtcctagtcgggttagttctaccttaggattccgctactttgtcagtttctttgatgattattccaggtgcacttggatatttttgatgaaaaatcgatctgagttgttttctattttccagacctttcacgctgaaattcaaaatcaatttggggtttctatccgcacatttcgtagtgataatgccctagagtatttgtcttccccatttcagcagtttatgaactcctatgggattattcatcaaacatcttgtccgtacacatcccaacaaaatgggatagctgaaagaaagaatagacatcttattgaaactgctcgtaccctactcatacaatctcatgttccgctgcgtttttggggatgcagttcttacatcttgttatcttattaatcgtatgccatcttcagctatccaaaatcaagttccattctctgacctgtttccccacttacctttgttctctctttcaccccgtgtctttgagagtacgtgctttgttcatgaccttactccaggaaaagataagttagctcctcgtgctcttaagtgcatatttctgggttactcaagaacgcaaaagggatattgatgttattctcctgaccttcagcgatttcttatgtctgctgatgttaccttctttgaaacccaatcatacttcacaggtccagttaatcacttagatatttctgaggtgctactcgtcccttctattggagattcagtccctatctcccattcatcttcctccatagctccaccgcctacaactctagttgcagctccaccacctatagctccagttccaccaactatagctccagtaccaccacctagtctagttccaccaactatagctccagtgccaccacctagtccagttcaaccttctacagctccaccactcctgacttatcatcgtcgtccgcccccagcatcaggcccagctgattcatgtcctgcaacctgaccctgctaatactgcggacttgtctcctcttaaccaaccgattgcactacgaaaaggtatacggtccacttaatcctaatcctcattatgtcggtttaagttaccatcgtctctcatcatcccattgtgcatttgtgtcatctttgtcctctgtttccatccctaagtaagcactctcatcccggatggcgacagacaatgattgacgagatgtctgctttacatacgagtggtacttgggagcttgttcctcttccttcgggtaaatcgactgttggttgtcattgggtgtatgcagtcaaagttggtccagatggttaggttgatcgacttagggctcatcttgttgccaaaggatatactcagatatttggactcgattacagtgatactttctctcccgtggctaaaattgcatcaatccgcctttttctatccatggctgctgttcgccattggcctctctatcagttggacattaagaatgtttttcttcacggtgaccttgaggatgaggtttatatggagcaaccacctgattttgttgctcagggggagtctagtggccttgtatgtcggttgcaccagtccctctatggtctaaagcagtctcctcgagcctggtttggtaagttcagcacagttattcaggagtttagcatgactcgtagtgaagctgatcactctgtattttatcgacattttgcttcaaatctctgtatttatctggtcgtttatgttgacgatattgttattaccggcaataatcaggatggtattagttagttgaagcaacatctctttcagcactttcagactaaggatctgggcagattaaagtattttctgggtattgaggtcgttcagtctagctcaggtattgtgatctcacaacggaagtatgccttagatattcttgaggagacaggaatacaggttgtagatctgttgacactccgatggatccgaattctaaacttctgccaggacaggggagcctcttagcgatcctgcaagatataggcggttggttggtaaattaaattacctcacagtgactagacctgacatttcctttcctgtgagtgttgtgagttagtttatggattctccatgtgatagtcgttaggatgcagttgtccgcattcttcggtatataaaatcagctccaggcaaaggcttattgtttgaggatcgaggccatgagcaaatcgttggatactcagatgctgattgggcaagatcaccttatgataaacgttttacgtctggatattgtgtcttagtaggaggaaatttggtgtcttggaagagcaagaaatagaatgtggttgctcggtctagtgcagaagtagaatatcgaacaatggctacatgtgagctaatttggataaaacagttgctcaaggagttgaaatttggtgagattagtcagatgggacttgtgtgtaataatcaagctgctcttcatattgcgtcaaatccagtgttccatgagagaactaaacacatcgagattgactgtcactttgttagagaaaagatactctcgggagatattgctacaaaatttgtgaagtcgaatgatcagcttgctgatattttcaccaagtccctcactggtcctcgtattagttacatatgtaacaagctcggtacatatgatttatatgcaccagcttgagggggagtgttagtttgatagttaaatagtatagtaaataaccctaatctcatatgtattaggagtaggacatatatatatatatatatatatagggctcattgtatcattgtcaatattaatcaagaatattttctcccgtcctttctcacaaggaccaaatgtgatcacatgctttgcgtggattcactcattatcatacttcaggaaatgatcaatatgttaacttttcatcaaaagaaaatgataaacttgttaactcttggaaaatgcagtatttatcaatggggggcagactaatgttgattaaaagtgtcatggacaacattcctacttatatcatgtccctcttccctatgccaagcagagtcaaaaagcagctagataaagccagaagatcattcctatgggagggcaatagtgaagatcacaagtttcatttggtcaagtggtccaaagtaatcatgcctgagcaccaaggtggtctaggagttagggatctacaaaagcacaataggagccttttattgaagtggtggtggaggtatgctcaagaaaattcttgcatatggaagaaggtggtgacagctaagtatgggaagttggacaactggagcaccaaacaaagtagagctccacatggagttggaccctggaagtatatcaacagcttaaaacaggaattctttccagaggtatacttcaaagtaggggatggcagatttgttaaattctggttgataggtggatcctgccccaacctttaaaagacacacactcaggcattttccagatagccttggatccagactcatcaattgcacagaatagagcagggaacttatgggaaccactcttcagaaggaacctgcaggattgagaactagaggaactatttgatctcttcagaatcattgaaggttcttccatagaccttcaaactacagacatgctaagatggggcaactccaaggaacctgcaggattgggaactagaggaactatttgatctcttcagaatcattgaaggttcttccatagaccttcaaactacagacaggctaagatggggcaactccagcaagggtacaacaaattgtgtgcacctaatggaatgattgacaattggccatggaaacatatttggagatcaaaactacccactaaagttatttgtttctcctggattgcccttaggaatgctacactgacacaggacaatctatgcagaaggagcatccaactggtcaatagatgttacatgtgctgcagcaatactgaatcagtaaattacctttctttgcactgttcagtggcatctgacatctggaacatgttcttagcagtttatgcaatacctatggacatcagagaggcatttgaaggctggtgctcctggaaaatttgagaaatccataaaaaaaacctggcaagtgatcccaacttgtatctgctggagtatatggacagaaaggaattccagatgttttgaaggcatctcaacttccaccagctgtttgaagtctaaatgtctagtgaatttgtttagttggagctacctctcccctgtgaatgatgccattttccttttagattttattagctcccttagcatggcataatgcctcttttgattttggtcttggctaactcaagtattatagttttttgtctttacagagttagccaaggactcacactttgtaattttctggcatcttcttgatgcattcaatgaaacatcttacttcatcaaaaaaaaaaaaagagtattgtgtcaaatttgcatcaagataatgctattattcttattattttataaaatgagaacttacatcaataaaatttggcggtgggaagagataagatccccttcttcaaaataatgctattattttgaaacgagaacttacatcaataaaatttggtgtaagtaacgagaagggaaaaaaataatgctattatttttattattttataaaatgagaacttacatcaataaaatttggtggtgggaagagataagatccccttcttcaaagacttaccaaattagcttttgacgtcccatgattctgctagtttagaaacaccaccagggaccggctcaatgagcacctttgggcggcacaagacgattccacatatcgaggtcggaatgggatcgggtgtttttacgtcttaccgtagaggtcggtccgtgacccccggatgctgaaggcgtcctatcttccttctctcatatttggggttccacatatgctctaacccccacccccaaaccgaaaaaccaaaaataaagggccatggagctccatcaacattatttccatgatcaggcccatagatcagtggaggggcatttttgaactctacataaattgccattgacacttcagataattcagataatagtagggtaaagcggctccttttggatactgcctctgtgctcatcgcagtttcttcagtaagcttagagcttctttctggcttattttgctctggatagctttttgtctcatcttacctgggcttcacattcgttttcatgttttcctctcaccttatgttcctccatttcaaacctattcttctttaattgcaatcctttctatgtctggtttccatcttgggattctgcctttttcccctctacaagttccagggacatgccaaatgcaaacgttgtgttacttaagtgatggccgccttttgctttgttgcttgtttttcccaaagcacctgaatttgtattgaggcatagctgattgatgtttttggatacgtaggtgattgaatttttttttttttttaaatattcacgaggatattgcatgaatcgagtaaacttcaaacaaagcagccattatggttccgataataaactatcaaggtttaaaactttgtcaaagtttgtttcatagaaagattcaaatatttcaaggccagtggcatgtttccaaaatccaacctccatcctcccaaaaatgctccttcctgctgcacggctgcaagaaagaaaaaggatctgtttcacttcactcactgggataagcacatctttttgttttaacttgctagattttgaagcttatattgatctatttacttcctaaagagatgtcccaggcctgcttacatctagagattttgactttaggctttcttcggtttttcgctatcatttagaaatgcacatgttttagtctgttgatttgctattgatatttatgttgctattctaacttctttgattgcagtcacctggtgattgagacatcacaagaagttagtgatgttccttttgcagattattttcgagtgcaggtatgagctttacttttcataagggtctgctttctcgttagcactagtactacttgaggttatcttggacgggtttttgatcagtattgattataaatctgcacttgcatctatcctttttttttaaatgaaaaactgcacttgcttctatcattaaggtggtgcacaattcatgcgagataaccgattgggacatattcgtaccaaagaaatgtctcataaacggaaaattaaaaggtagacattgactgtgaaaattaagaaaggaccttaggaaatgctgctgctgtctttccttctcacattgcgatcatgttcgtaaacaaccattgctacccttctgtaatcatcagtcactctgttgaacaccagccaaaggggtcatttttctgggatatatggggttatgtttggtgggataaactttgggcaaatgtttgatggtcttaagtgcttagtctaattcttttctgggccccgccggatgaggggatttttggcatttttccctttctctccccactcaccttggactcttcttcccttaattctgtgttttgcgttgaatgttccttggatttttctttgtttgttttggactataattcaaccttatttgaatagattaaggatcgtattatagtattgctaagtaggaaccggatagttttatctgcccagtgttattagcaaattagtgtaagcactctgaatgttggtacatttatcttacctggctttgctgcctgggttattatgttcttaacttatcctgcctgaagtcatgtgaccttaatattgctggtttattatccccctcatgccagggtcatctccacaaacattagaattccaatctccttgcaacagtttgcaaccttccatagctgctactagcctgttaaatttaaactgtcaattcctgaaaacacattatcaaaatgattatgtatgttatgttattttatgttattttattatgcgtctattgatagtactaatatatcgtctctcttgttgctttcttgagccgagggtctcccggaaacagcctctctgcccctcggggtaggggtaaggtctgcgtacatattaccctccccagaccccacttgtgggattatactgggccgttgttgttgttgttgtaaattcatagatttgaaaatactatctggaacttgaagcttggaaagagaaatatcaattgacctcagtatttcttatgtacaattcaagcatggttagttttgtcctcccagctataggactctcatacctaagagggccaaaatatgtgtttttttttgttcttttagaggctgtttgaggttagtttgttggtgaaaggagaggttgagttgtttctctttcccactttttattttctttttctcggggatggtaggggatagaatgtggggatggggaggtgacaaggagtggtggctgtttgttgtctaaactgggtctgtcttgctgagactctaatgcaactgttcttgataaagtaataaagggattttcatgtgtaagtcagctcacagataaattatccccaaaaaagggttagccagcagagagtttaaactttaagcagccaaggtaagtatactttgtcagttcatttatgtctaactgaacaaccatttttacagaattgacaattgccaatttttatatgatgcttgaagatgaatatataagtaagtgagatacagagatactgaggagagaacaatcacattcaactgtacttttccaggatcatttgttctagataacgttgttcaatctatattgctgcatgtggtgtctgtttcacatctgagccgattctaacttaaccagtgttccgtctgtctaactttgttttctagttgaattgtagaccatcaaacaatgtcgtcttttgttttcagatttcccaatcacaaaattggtggctgatatatagtatattcatgtagtttatagattccatatgtttcaggttagccaatattggattccttgtgttggaggagggggggggggggggggagggttgttggtcatgttgaaatattttcgattttatcttagtttcttctcatgatatatttcttcctttcacattagggtttttgggatgtggagaaggatcacgatgaaccagtaggaggctgcagtttgaaggtgtacgtaaatgtggccttttcaaagaaaaccatgtttagaggtgcacatgtgtctttattgctcatatataccttcttcaagtttgacttactgtaattttcaaagaaacagcaagtgacttcttttttctcaagaaggaactgcaagtgtgatcttactgcgactttaagaggcgttgaaatctgggctagaatatcgtggctttttttcctttcctcttgtatgcagggctttccaccgactcatcaataatttaataatttcataaagcatcttgccttctcattattgaaagagttatgcttttggtgatagattaatcaaatgcttctatatgctataatccttctttattcaaagggcttcttatttataactctgacttggcttgtaagtaaacgtttgtgggagcacgggatgatgatgaaaatataaatcaataaagagacagaaaaaatgcaaaaaacagctactgctatcaatacaatattaaagtaaaagtgactaagctcaacggacacctatgtagcaattgcacaggaatggtcaattgtggcacaattagttcaattattttagagaccatttgatccaaaaagttactgttgctgcttttgccatatcgtggggctctccagctctaggaagtttgtgtctaggatctggtaattgacgattacttcttctggtcggcttgtactaacatgtgctttagaggcatatcacttttactatcaggatctggatctttgttttctagaaggaaaaaatgggttcctttcacttcgagttcttttgttgtaatcaaatatgatagagctggataaacaaggcaaggatcgcctgctcttcaatgcttgataggttaaccaaatgctttgatgtgcttagtacacttttgatgattgattaatcaaaatatttcgccactgatgctacatggggcttatccactcatattcgatttctttgcttctcctgaaaaggggtgtcaaataggcggattgggctacatttggacaggtcaaaataggttgcatcaaataaacgggctgggctataacctgctcaatgtttgcttgggttgaaaggggcgagtcaacttgggctaaacaatgggtcattgacccatccagcccaactcaaaacgttttccatttatttgtttgttcttttataatctgtttaataatcatatcaaaataataaaatatttttctttgtttattatgactattttaaacaaactgaactcaaaaaaaaaaaaacctttttgtgttttgataagttttcttatggatcattgccaaaatgacccgccaataaatatatccaagcccaaccctcaacaccccagttctgatgttgacttgaaatgttgaacaaatctacatcccattttttggagaattaatatagataaccatttgctagtgctcttccttcaactgagcctcatttatgtttgatcaatcatattttagttagtaatttcctagagtttatcttttaagttgctggtgattttccattggcagtcattatgagcatctatgttcttagttttttgcacaactaggggtttaatagttgttttatgctaagatgaaacttaagctttcagaaaattcctttatttattctgacactaactgtaagaccgtgaagccgacgcagctatttgctggtgctcttccttccacccagtcttagttgtgttccatcatatcatgtcctttaagttgttagcaatgatccattggcaaggtattatgaggatcagagctatattttttgttgcccaagttgaagtttaaagagttttatataaacaatccccacttgtatgtatagatattcctgagtctggggtctattggaaacaacctctctaccttcaagctaggggtaaggtatgcgtacattctactctactcagaccccacttgtgggattatactagtgtttgttattgttgttgctatacttgtatgtatagatattgaagagttttggtttggtaggctctttgaaagtgtgttttcatgttttcaaagtttacatgattgaaaatagagagagtttttcacctcatccacatggcatggcttgacatgatagtaaatacagaaagaagtttttcaccaaaggcatgatatgtgcagcactttttgcgtatatgttttgatataacaaattttgagcaagacgagatacaacagaaaaaagtggtcctacttaggatttgatgtgcattttagtgtatccttgttagtttcaatgcttaagcagttaagggaaaaaggtaacttatgatgatcaccttacaaaaatatctgtttggctgctaaatgcttggaaatctctgcagggaagatagtgcagtctactgttgatgaatgtcgagacgtgtatgcaatatggattgcccttgtatttttctcatcccttccggtttcttctattttcagtttgcaggtatttcaaggctgtttaagagattgatttgggtttttatttcaggcacatgaactgttgaagcaaaagaagttagagaaggaagaaggtagtgcttctgggaacctcttgtatcatacctttgtctgtaacaattggcatctgctgttttatatgttgcagtatatgttctttgattccaggctcacattatctgattaaattattttctgtatcagccggtggtcatgctgctaatgtggtaacaagtgctcagcagaaagaaagttctgaacatgtggaaatattagacggggcaagtgatgaagttaggtcacaaacactgccactcaaccagctagctgctgattccctgcggggtagttgtagcagtaccgtctctgttacttccttgtgtagaaatttcatggttaagtgttcatcatctttcaaatctcaaagccaggtttccattcttatagtgatcaccattgctgtgatcctgctcttaatgcaggtatgtttctcaatttgcgccttctatctgagattacgtttaactaatttgctaccacaaactgttcctcatatgatgttgtgagcaagggaaagtaaactgctttggtcatgtgatcacgcagttgctgattttcatgcttttttctgttaatcgttagggttgttagggtcaacaaatagttactggagaatttgtcaactgcagattgtacgcttgtttttggtctgaccctttttccctgattttggggttagtgtcgtgatactctctgtaaactattcttggtacagtagaattcacctttcgatgtccaagatagcgatgcaaacactccctccttaccattttaattgacttgggttgaccttcaaggtttgaatggcttattgtattggtttatttgaggagatcaaaataataatttgaagtgtgaggaagtgtacaaatttgttggaaagatcaattttgaagtaataaaaagtagcatatattcatatttgtttgaatagaaggggaaaaagttggaacaaattatgattgaaatcatagtactgacgaattaaggtagaaaccgggttaataaaatggtgacaagagagggaatgtaattagctgcatgttacaagagttggctgactttcggtggtagaagtaggttagggctatacgagctgatattcttgtatgtttgctctttccatcttgtttaaatgtaggaaaatgctgtccttgttcccttcgttttgatgcatgtggaacatgctttgtatttatctgtctctcctatgagatgtacatcatctgatcctggcattactctttttcattatatgccttctggaaaacaagtcaacattaccccctcccctgcaaccaactaatttgcgagtttcagcccagcctggcttttgtttgactctgtcaattttgttctaatttgtttgttactttgtatatgtgatgcattgatcttctagtgtgcatgacttaatctgttttcacatatggtggtcctcagaacagatcgatcagtcaatattgctgtcagaacttctcttgcaaactgaggtgaaacataaattttgctgtctaatcttttggtgtaatcaaacttcatttgcagatgagcatactcgtgttattaggtagacctcagcacgtccacgtgatacctcaaggggactgcacaggtagcatgtatcgactgggagataggggtatagacacactagcctttctggataaacagattagtcatctcaaagaggagatggttatggtcgaaacactgctcggcaaaatgcagcaggagcatacacttctaaacacgaaattgaaagagtttgagcgcctacggaagcaccagaaaggataaacgagctgtgtacatagatgctgctgcttcttttcttcccttccttattatcttctttttgggtgaaaggcttgtatgttgtacatttttctgatttttcgacattcatgtacattttgaattaattacatggttgcactatctacataaaatagtaaaacaaggttactggactgtttataaatatgcaagcgccccaagagcttctttatataaacacatataatgattagaataattatggaaataggataaacatgcgtataatatgtgatgctaaatatatatactcaatactcttccaatatctaaccatctaaattacacaaactcgttttggaagatatcaagcacaagttaacttcgttacagttatataatatgcaaattgagagtgcaaaagcactaaaatattttgaaatgagtaaccattaacatattgtagggatgaatcaattctgcacgtcacattttatagtgataagttatgtgattgtgttttgatgatttaacaaagcctgatacaaagcctcaaagtgttcggaacaaaaagtcacatgtctggcacaagttccaaatatcaatcaagggagcagcaaagggaccatattgctatcagttccttggatcacattataagttaactctttacggctgtcaaatgttacaccccatgttttttacgtgagagtacgtcgtaagtcaattaatgtaagctcagaaataagatcgtctttgaaagtacaaaaagtaagttaatcatgttatcttggaagttacaaatctttaaagtcatgaataacaagtaccaagagggttgaaaggcttacaagctaaacaaattgaagaaaataagtttcgtcgaatgtcgacaagttgtgaatgttataacatgtacatttggggtgatagtaaggtgcttaacatgataaagaagtaatgttatgagttattttagtcgtatgatagtcgtgtattatgatttgaagtcaaacgagttgtgaaacaaaagttggcaaaggtcatcacaagttacattcataaattatgatgaaaattaggtcaaatgtagctaagcttttatcccaatatacttgaaattacgggattatccacctaccagaaggtctacgagtctagtttccaacgcattaaacccttcatcgatacaagatcgaagtagagagatattcgtatttttgcgagactgcgcaaacagctccctatggggcccacttaggcagttgagacatcttgatgtatatgtgacgcctaaaactcgttttaactcattatttttcaccctcttcaaaccctagacacctaaaaacgttctctcaaatttctctcatgatccaagacccaaaccatgggcgaataacacaaatcaagtgtcgggaatcccgtgatgctagtgagtttcttgttcttcttgtggttgctgattttggtgtggttccatctcgtgtggggagttttttaaagtgatttacgttctgtaaaatactcttccaaggttttcatattgatcctaggtgattttaagtcttccaaagtgattctagagccgagaagcccgaattgattgctagttttgcttccttgttcttgtggctgttttggagcattcttcaagttaagtaaccacaaatttcatatttttcttgttgtttaaggtaataatcagtccttccttcatatattagattttcaaggcgaaatacaagtgtttacacacaccaacttgaacacaaatgttgattcaagaagagaatacaactcatatagtgttgtggtgtgattgagggttgttgtgagctacaatagatggggatttcaagttgtatatacttccaaaggtaattatatcatgttcttggttgtgcttaaggttatcttgatgtagattaagttaaatggatggactagacatgaactagagaataaagttgctaattgaggatagttggatttgtggattattttctttattataaatatatggtgtaatgctggaatcattgatgaatgacttaattatcatgttaatgatacttttaagctaaattaagaagtctataagtggtgatatagggtatacgtgatccaatcagagtttgccgctcatcgtgaagtagttgtgacttgttgttgttatatggtgtcttgttattgatacttatatgttgccggattgttctagttgttgtttttggtatatggtatttgaggaggcactttttataggggagatgctgccgaaattacgttaataagctgctagcttaagttactgatatagcctttactcaacactgattttgaatctccttctgctatggtagattgagttgaattgtttgaataattgcttggaaagtattaaggactcaagggggtcaaggtatgttaaggctatcaatattcccttttagcatgatccttatgatacaaacgaaacgagcaaacacggaactttcacaaatgacgttattcttagaattactaggggtgcctaagttcttgatttcccatgtgtcctattattatatcatctgttcatgggtctcagaaaatatgtatgttgataaagtttattttatgatattaaccgaaggcatattgatcttatgataccctgagtgatcttattgacttacttctcatgcattgcattcatttatacatgtatattgatccatgaccagatgacattatatacgcgtatattatatatatatggggtatgagaaatggttatggcattatatacgcaaccaccatcttatcagttggtatacgttgatgatttcgcccagagaggtcgagatgatatgataagatgccctcggaggcttgacgatgttatgtacgcatatacctatgcatgatatgacatttatacgatacgcatgaaattatgaatgtttcatgattcacagagctattcaaacttacaggttgagtccttttacttcatgtttctttcatgtcttttatatactatttttcatgccttacatactcggtactttatttgtactgacgtattttttgcccggggacgctgcgtttcatgctcgcaggtcctgatagataggttggcagtcctcctagtaggctatcagctcagcggaaggtgttagagcactccacttgctccagagttgtctatttgattagtattcttaggacatgtattgattggtatgacggggccctctcccggcctttatgatgtttatgtaatcttagaggcttgtggacatatgtcatgtatatggatgattgtatagccttgtcggcctatgttttgtgtgtacaaatgatcatttcgatcttataggtatgtatgtcacatgtatacgtttgtatactatattgggtcatcctaggttgagtattctcttatgtttaattctggttatctcatgacggcctttcaggcttatttacccatgattgtacgataataaggatatgttacattagtactcgattgagttaggcactaggtgatcgtcgtagcccttcggtttgggtcgtggcattaaagttgttgcactgcaggcgcaacagtgcaacaatcactttgaagcatgttatgtaccaatacgtgcttgtataatcttagtgacctcacttatatattatcaacatgaagcaatgaatacacacgctcgcaaaccctacaacattattttctctcaagtgtgcaaccgcctttatttactccaaggcttgaagaacaaagaagcaacagaacaaatgagcagatccaagcactgagttcatcatgtgtccttagtattattgtacctttgttaattttattcacttgtaattcctactcatcttagtaagaagcatctcgtagaatatctttgtaaaccataagccttgtgtctgtgtttgactagagttcatccaagtggtgagctttgtaataatagagttattacaaagagacttgcaatagagttattgcaagtaggtgaaggattaagagtttaattcctaggttacaataggttgtaatttaaagttgctcgattagtgaagttgaaatcctacgagcgtgagctgagagttttccacgtaaaatactaatgtgttatttacttaccgttgtgtgtgtgtgctctgtgagaactgatagagaatcaagttctctatacaatttggtggactcttagtttacatcaattggtatcagagtaggttctttctataaggctaacaccttttaaggatctacatggctgctccaccaaattttgaagaaggtcaatcaacctacaaaccaccaagattcaatggacaatactatagttagtggaagacaagaatacatgattttatcattctgaaaatttggagatttggaatgtcatttgtgatggacccttcgtccctatgaagaccattggcaatacagcagtgacaatcccaaaaataaagaaggaatacaatgatgccgatcgcaaagctatcgagaaaaacttccgagcaaagaagttccttgtttgtggtattagaccagacaagtacaacaaaatctcatcttgtcaattttccaagtatatttggaaggatctcgaaaccgcacatgaaggaaactctcaagtcaagtagtcaaagatcaacatgctcactgttgagtatgatctcttcaaaataaaggatgatgagtccattcaggacatgcatactcgcttcacttccatcatcaatgagctccatcttctagggatgatcattccaaggaacaaattggtcaggaaaatacttagtatgttaactggttcttgggagagtgacgagttagtatgttaactggttcttgggagagtgacgagcttgaaatacacacttaaatatgctcgctagtcgaatatagtaatttataatatcgtatccacatggattggaattaaatagtattatcataatttgtagctagatttgctatccaagataatcaacaatggagatttatgtgatttaaacttgatagaatataagggtccaccaaactctattgagaaccaggttctctattaggttcaacagtacacacacacagtagtaaataaatgacaagaggaatttcacatggaaaattcccaactcaacgggattaaaaaccacgacctacccttgtaggatttcaactgcactactgagcaacttttagattacaacctatgcaacctaggaattaacgtcttaatccctcactaacttgtaacatacctattataagccactttgtaataaatctattacaaagactttacaacatgactaactctagccaagactcaaacacacaggtttaaggtttacagaagagttcctacagaatgcttctaaacaagctaagtaggaaatacaaataaagaactattacaaagttacaactcaactaaggacataaaatgacttgatataggaactggtctgtagttgctttgttctttattcttgaagcacttgaaactttcttgctggatagtcacatgagaagcttgagtaaaatctctaagtgttcaagtgaatgtgttttacctcccttggtgttaataatacatgtatgacctcacataaaatgatgtaagcaaggtaggtaaaaagccttccacagaaagttgactgttgcactgttcttgtacaaatgcgtgtgcaggcagcaactttacagctggagagttgacttcgtacagtctcatcgggaattggtagggacgtattccctcagttgttccttccactctgaggagttgaatcatatcccaacctggaaccttgtgatcttaaggtcttgtatatatgaaacaagttccttatttggttctggttagtaagtttgttggataatcaaaacataaagtaaaatacatatgaccaaagtacttgtaacctatcaattttttcctttttgatgatcacaaactcattattaaaaatcccagaaagagccatatagaaccagactgcgaactagaaagaccttaagtttccccctgaatctttgcatcccccttaattagtacctgaacctctgtgagttccccctgaatctgttacctgggcttctgtgagttcccagtttccccctgaatctatcctttccccttgaatctgttacatgaacctctgtgagttcctaattcccctgaatctgtatttctcccccttcagattattattcaattatgctctttattattcaattgaatccttccccttttggcatcataaaaagcacagaacaagtatgtagcataaagaagtctagcatagttaactcatgccacttgtgtgcacacaatatgatagaaaatagaaataaaagagcagcataaacaacaaaaaggaaaccacttgcattaaccaaatttggacttttacaggtgggagcaaaatcattgttatcatccatagtttaaaacaaacaaaaaaattgccagaaacaaagaaaaacatcaccaaaaacaacttaaaaagatggacattggaaactggacattgaggggacaatctttaggggacactagaggaagggggcttagaagaggaagcaaggggttggaggacaagatccatgtgagcattcgtggacatttgctcattgagcagtctttctttcagatcctccacttgtttcctaatctcagcattctcctttgttaggtgtgcaacttctgagctatgagaactactagaaccatgtgcctgttgtaattgactgagctgactctcaagaattgcattcctagctttcaacttccggatctcctctatggcgttattctgagcatttattagttgagagatagtggaagttcttccaactcctccggctttgtcaatacactcacactcctcaagagtagttttggaaaaggattgctttttagtgcccactttggcctgtcccagaggtactttaaaggactcaaagacctttgtgataagaaaaccataaggtagtccaggatttccatccttaagattttctaccttctgcatatgctcaatcattatgccaagcaaattgatggtggtaaaattatccaaggcttccacaaggaatatgtcagctttggatgcaacaaatcttctctcagcgcggggaagaaacactttgttaaccatctcaaaaagcaattgatatactggaataagtgccttcttatgcacctgttccccatattgtattgccttgtccttgacaatggcatttctgaagtttgatatgcaggcaccctgaacagacgacagtacttcggtaggaacacccagaattgaccccaataaggcggagtgcatcactatgtccaccccatttatcaacacacaaatttgatcaccctctattgtgaagaggctggaatagaaactcggtacctcctcctcatacactttgggaacctcatttgtaaacaaatttatctattgttgagaatcacaaatttccaccaattgtctcatcccagcaagttctagaatgttagaggcaaatgtgcagccccatagtactttctgattttttaacttccttttcacagtactgagagactcactaacttttgctttcttgatggaaccaggttcctcatcatcgtccaattttctttttactgacttgcgaaaagactttcccttctccactgactttttatgcatatcttcagcagatttttccacttcttcatcatcagacttgtcaccactctctttcactatcttgtcacaagaacttttcaccaacatttcattggaagcagtatcatcactcttgaaattactttcagcatttgtagaagtgtgccttatagattgagagtaagagtgcttctgcttcaaggacttgtgaattaaggaactaggttcctcttctgcttcctcatcaacatttaccatagggacgaccttttcatgcacaactcttccatcctttaccagccttctctttcttttgctcctttgactcttcttgagagcagactctagagactccttttgctgcaaccgagtaatgggtcgcttagggattgactctggagttgcaactagcttactcctagccctgataaaactagcatattacaagtcatttgtgtcttcctcactatcagaattcatctcagccaacaccatattcagaggctgagcatagaagtggggagaaagagcatgatcaacacttgggaccccagtaatgccatcttgactcggttgttcaaatggaacaagtgctccgcagtcttctgtagcatgagtcttttcctcctaagactcaaaccctcctccaccttcctctataacaaccccttctgaagcaatgaaaaacatattttctattccctcattttcttgtgtttcatggatatttcaagagaaagaggagtgatacctgtaaaatagcagcttgtcatggttgtcccagtcttttcatgaccaatcattggatttcacttgagtgcccattcatggagagagttgatgtttcctaaacaaggttcccttgtttaccctgtttactctatttgaccggtgagactttctcagataaggaacataatcggagtgggtaggagagggagtggagtgtgggggagactctgctttaaggttttgactactgattgtgtcagggaaggagtttgccactggaatgctgactggtatggactcaatcacaatattgtcaggtacactggaggtttcttgattttcagacataatgagatttgtttactgtgaaaatggtaacaataattaaatttgtaaatggaattctaaaaatatgtgacctattctcaagctaattgttagagcagatgatgctaagaacatgaagtttaacgatgaggtgcaagctaaaatgaggcagtaatcaaatcgaaggggcctgttgcccagatgcagaatcggtcgatacggacctcggggtcgagattcgagtcgagctcaagatatcgggggcagccgggaatgggataacaattaaggatacgattaagtagggctctttacgaccgatattgagaaatatagtgaagaacaagtaagagaatgatagatattaaagtgacctcgggccagtgagaacgagcaagttagaaagaaaagagagagagatattattgcatttgtgaagaaatggagcaacatcagccctttacaaggtagggtgagtcccctttatatatgagggaggactcggctacaagtatgtggagattaattacaaagtatggagataggatggcttgacgtgatgcctcaacataggctctggataggccggccctgtaagacttagccgtgtgccttgggagcttctccctctgtcctggcttcagtctccattttctctgagtcgggtttcggcgagccccgaggttgggaactcggtcgtggcctcccggggggtcccgagggatgcttctgaaatgacttgacaacgagaaatcaagtcttctgattttgccgcgtacagatagtctccgcattttccataacaaagtgatagaaatgattgtgacacttgactcttcgagcttcttttggcgacgccatatcaatgatgcaactcctggcgtgagctttgtggtaaccggacacctaccgactcgtgcttttcgacctcgttcattgcactcctgattctttcttcctatggtgaaggtaccgccgtcggttcggttttccatggatgcattgactgcggccgtcagtcaatcttccaaagcctagatgatcgtgtcgtaaccccctataaatgggggtgccttggctttgcttttcctatcccagtgcctccgttgacttgcttgcctatttcttcttatcatcttctttcacccttgaacatcatgctaggggctcatggcctcaaggccgtttgacggaggttccttagaccgtgtcgtggccttctaccggggcttcccttcgtcgagcataaccatgttgtcccgctactgatgtggccgttaacatgttcattgtggctggtattactggcccgaggtgatgatggacggggagttagtttccccatcatgtagacagtcattcggattatgcaccgctgctcaccttcataccccgactcgacgttgtgctctgctccaagttgggggcttgcacgactagacattccaaggagttgattctaagtagccgtgcaagcgggactgaggattattcggtctactatctctccaagcttcccttggccaaagagggtcctcaagcttcggagagctacaacgttttttcatccctccctgccactcaccttgtcccttggggatatcagtgtggaaggttgggatgaaacttccaagggtgcgcgtccggaggcacctgttgcggaccttcgaagatggaccgatcttcgagctttcactttgcgtgtgcatccctttgtctattcctttaggcgtagagatcctccgtaggattttgtcattgtatgtaatgtcccctcgagggctattgtacatagatcttttatgaatatgaatatactccattgacttctgctttcgatctttgttttgtttctgtatgctctcatgtcctttgaggccctttgagtgccttcctttatttgttgatcgtcgatatctgacttgggcgcgggcttctttccgctcttctactggtcgacatggctctctattgaacccatcgtcgtacttcagactaatcccagattgatacttcggaccaatcccagattgatctgattggcccgggataccgaggtcctccgagttgtatggagacaatgcgtcgaatttcggatccttcaggaatgttatcctgaacgaaggtcagcttcgggtacccaggggtcctttttgatcttgatgtagataacctttttttaaagcgtataggatagacttctgctgaggagttgcctatactcaggcgctgcttcggaccctcatggagctttagcgatcggagcttcctgtgtttattcctctttttagaaagagggaatcacaagaccaggtacttgccttgcatcgagtgatggcgttgaaagctttccgaagtccaacttctccttggcggggatcctcggggtagagcgctatctcgggattggacataatacggacaatttctcgaactttggcttctcgtcgaaggatgttttcgggattgggtatgaccccgtcgatctgtatcgaggctgtaggtttcttgggctcactctgggtaggcgagtcatcgctgcttcttgcatatatgtggggcggcttcggcttcttcgcaagacctcactattttagatagctacccttctgctttggcatagggttctccatttcttcaggcgcaaaaaacattggcgcacgtccttgctctgatctgttagttttaccacaatcatggtgagcacttcggggccggcccgtcaggaagtagggagtgctgctcctggcgctcaggatccactagggtttgttccgaagactgtttctacgataaaagaggaacatctggagatggtgaggagatactgcgggtggagtgaggggataacactgcaagtgctttccccagatgagagtattacggactccactgatggattcttgagcatatacctataccctttcgcatttggcccccctgatagggttgtgcttgatttttgcttaaagtatcgggttactctggcgcagatacatccgttattttggtgagtggtgctgatgatgaggttctttgcggagaaggctgggctcgaattcacgtttgatcacctcgttaggctataccagccctttcatcatcgaggcctgctaactctgaggtgccgtttatccacgccctttgttgttgatgatgaagaagatggggatcgagagtgggccagttggattattcgggtccggacgactgacatcatccctacggggcttttgtcatttcccaaagggtggaatcatgcacgtgcgtggggcgtttggtgtcacacctcactttttacgggagttttttccaacttaaagtgacaatcgaaacgggatcattttattaaaaattcagagtcgccacttgggataatttatggtgtcccaagtcaccggtttagaatcccgaatcgaggaaaagattgactctgttttacagtccgcgaacttagaaatccaggtaaggaattctgttaacccgggagaaggtgttaggcattcccgagttccgtagttctagcacggtcgctcaactgttataattggcctattatctgattttaatacatgttttagcatatgatacatttttaacttattagccgcttttaattaattttaggaagattcaacgttatctgaaacacatcttgaaccacgccacatgaaatgcacccgcggtccacgacacattttatttaacgttattgagatttggatttgggtcacatgaaatgcacacccgagtttaggaaggtaaattattaactagcacgcctaaagcaaaccacgcattgaattattttcctaatctttgagattgttataaggccaaatttatgaacaagatattattggggccaagggctagctaacatgatctattacttggcctagattctttatagttcaagacacaccttatgcccattcttattccttgtcaagaaagaaacaacttcaattttcatctacccaattaaaagtatttattcaagaacccaagactacatgcatcacaatcaaaataaaaaaaaagaaaaaaaaactaattaaaacaatttaaaggaaaactaggacatgctactcaaacaacgtggaatcacaaatcaaccaacacgcgcaccaagctattataacacaagaaaatgataatgaaaattgaaaaattgaccttttgttgatgcacaaagctgaaaattgcaagtcagtcgggctaaacaaagcaacaacctcgatggaaccgtgaattaagcgcaaacggactcaatttagcgcaaacggactcaatttagcacaaggaataattgactacattatcgagctggggttttattgttgtttgaatcgccacattgctgagaatcttttcctgaacagcaaggtttgagacccttttgttttcttgggcaagaccataaaccgtgagaggaaatatttctgaacgaaagtcgaatatccattggtatatctccactgtaattagcggcgaaatggattggccgtcaataagatagtggtttaaccaatattagcaccggaatgtaagttcttcaatgtcgactctaatctgtgcaacaatttaaaacactaaaaagcaaggtaaggatatccaagaaccaatcagcaaattcacaaataattcatcatctaattatgtaaaaataaaagtagaggaaaatctattgaaactttacaattaacacaaatttaactccttcagcatcgtttaccactttccttatcttctttactagtgatttcaagactttattgtctctccttgatttagctgcttgtttgagaaaagcattgaaatcattcacatctcgtagtaaattttcaactttactttttattccaataatcaagtcagcattgtagattaacaattacatcaagttttctactaagaatttcattgctacatctaccatggctgaagcaacaaattccgttgagcagaatataattgccactaaaatgggagctgccgttcttttttgtgtagtctaggtctaggaattaaaaaacttcgggtaaagtttctataattggatattttatatggaagtgggaagggatgatgaccattggatttgaaggaaatagatgactatgattaaatcttgcacttaaatgggctaatgggttgagaagaatgagctaagggtaattggggtggaccatgtctttttgtgtctcaattttgggctaagaagactccaaaattattattcaaaaccatagctaaattcctttaatataaaataactatactacatgatgcaaaaacaaattctaattaattaaactaaactatattaaaacatgaaactattatatattttttgtatttttcaagattatataaagataaaaataaggtactatttttgtatttttttactttatgaaaggtacataaaataaaatatttttgtaatttttattttcttgtaataaaataaagtaaaagagtcaaaattagttgaaatagcgatattaaacctaaattaaatatttacatgctaaagtataaaaaatcttggggagggtcaaaaatcacatgtctacatctggcgcttttttagattttgcctatagcgaaaattagttgagtaataatgttgtctcccttgttgcagcaacttcgtggatgccgggcgaagtccttgacctacccgactgggtccggagtttggtgaccattcgacctgcgacgagcgcaggtggcgagctgtatttcgtaccagatggggagtgaaataccaaggtatgtgcgtatgttgcctttgccttggcctttgtatagttgaggtaacattttcccctttcatttgtactagattcgccgtttacagatatcaggcggttccttgggatgaggtagtgctcttccgaagaggggaaggagtcgtcggccttcgagccgagggacgatggcgataagggggattggcacccgcggggtgatggagcttttagtggcgctgggcaggcccgtatcttcgaggagagggcatcgtccgagcctgatgttcccggagtatcagattcccgggcgacggttcctccgagtgaatatgctttgcccaaggttggttctcttggggccggagaggcatgatcaacatgagtatgttctgactttgaggaagtccgtcggcttctctttgaggtgagtttaggtgtgttttttcctgcatgtcgcgccctcctctcttcattgagttttccttgtgcaggcttatgataggcttatgtctgagctgctccgtcaaggggccaggctccaaaaaatcctgaatgagggcgagtcccttaggctccttagcgaggagaaggaggctgagttggtgcattggcactatgaggtgtatcagagctcaaactatgagagctatttgatggatcaggtaacttcctatattacgtgtttcactcctttctaaccttaaggctaaccccttttgttatatcagctgtagaaaaaggcggaggccttggagtacctcaaaggcgacgtcaaccacgtcagagttgcttgtggggagctaagggctcaagtgcaggctcgagctttggaggagataagtgcctcagccaaggtccctgccttcgaggtccaactctgcgtgactcgtgacaacgccaaagttaaagcggatatgattgggaaacttgaatctgatctctcgaaggtcagaactgagataatcgatgcccaggctaaagcgacattaagccgaaccaaggctgatcaggagatggcgattcgtatgaaagatgttgctgatgcccaagctgagctgaagcgagccctcgatcgggagaagaggatcgaggaatatgttcgttgtagatcccgaagagaggtactcgaggaggtcgatgcaaggggcttcgtcctctcgaaggaattggctcgagcaagggcggacgagcgtgatgctcggtcacttctcgctgacgtcgcggagggcgaatttgacaagctgtagacctttagtgtggagtgtagatttcgtcgttttgtcgctttgtttttgatatatgtagagcatgcatgtagatggagaatgcgcctttttcgtgcatgtaatatataggaagaaacttgaagctttatttcttctgtacctctcttctattattgctttcgaccgggcaggctggttttggtatttggcgggatcctcgtaggtccggaactgatcggacagacccaggggctcttgagtgtaatccttgacgtgagcagttcctggggcctccgtgcttggcccgactgtttaggcttagtttcctagttgggcttcgactcgagccttcttgcccttgaatcgtttatgcccgtgcgggcaggtagtaattgttcttatttcttgcccttgtgcatttgccgtttcgactattttgggtccagtctccgagtcgcatcgtgactcgagcttccattgagcctcaagctttttcctgcccgcatgggcggatgatgatggccttttgtgcttcgagtcgaagtgaccttacaggcgcgtggcccagagactcgctcggttggcaatagtggcatttatgccgtgctctaaggcatattgcagtttaactatttcgggtccaatctccgagtcgcgttgcgacttgagctttaattgaccctcaagtaccttttggttttcagactggcgatagtgcctcttacgctgttttggtcgttgggaccttttgatatgtggcccggaggcttgcatagttaactgttttggattcagtctctgaattgggttacgattcgagctcattttaatcctcaagttgtcaattttcaagctggtgacaatggctcttacgctgtttggtcgtagagaccttttagtgtgcggcccataggctcgtttggctggcgacaatggctcttatgctgttttgcttgtgggatttttctaggctttgttttccgctcgttaaggtcttttgaaatatttttgcctgacctatcatcagttctggaagaaccttgatttcaagtcattgtcggcgatgttttgagcacctcggaaggttcatagcttgtaggttgagtagatcaatgccttgcgattttggagccgacatggtcagagctcatttttgcctgttgagggaagcatgttttactcggttctttccgaagtatattcggagtagtgtcctgcaattttgtttagcaacagtcgggcatccccgagttgcgttattttggttatatcatccgttttgaccgtagtcatatgtgtttggccgtagccattttttttatcccgagtgatagtttaagcatctacaccgagggtatgccctttagggattcttacaaatgcgacgtatagcttaaacttcgggattttcatgcctgttgaggtcttacaatttgttatgcctattaaggtcttacagtttgtcatgcctatttaggtcttacagtttttcatgcctattgaggtcttacagtttttgtgatgtagaatagatctagttgagtctgcccgctaggggtcttacaggtttcgggttttccagcgtgtggcgattaatgacagtcttcgagtaatcaagtttgtttaagcttgaagaccgcttctcatgagttcagagttgccttgtgggggctttatgagcccggagttccgaccctggggtcgtgcgggtgttgaattgctgatgctaagtctctgagtatctcgggatgcatttggcggagaggcccttgccacgagtatgctgaaatccccttttccgaagtatgaaatgccgaaaatatattctttattgcttggcgtaaacatatgctgtaaatacatgttgtctcgttgttgtgatctcggcacgcgtaggtacgactcttcggaccatctgattcgttacaaggttcccttttgaaactcagttgctatcttcggtccttccgagggaatggtgcccttaagagaagatcatcactcgtcgtccgattgtagaagaaggcatgtgatcttattggatcgtgctggcgggacccttgttgggggtacgctgctccgctaataatcttgctggcgggaccctctttgggtttgaagtccggtcgagggaagagagcacggcgggccctgctaaggtcttggatctccgggtggagttagaacttctgaatgccccggttgattgcctacatacaggttagtgaaaaaataacaaaggagtgaaatagttcttcctcaccgcgggatgtgtaggtgacatttcaaggtttggtatgtttctgccgttccgaggcatgagccctaatacagctttctactgtgttcaaccaggcttggccaaagatgtggttttgcgtaccctccgatccctttgagggcggaggcattgacgccggcgatgagttatgtggtgaggatttttctctcgtcgcgtgtttccccttgccgccttattttaatcatgccctttgcatggaattcatctttccggtgaagtggggttgatgctgtctccgggcggtgtgccagtggttgtctgaataggacgcatgcgctttctatgatggtgcagagctcggcgtctcaacctgagctcagacgggctatatcaagagaatggttttcgtggcgatcgtcatccggaatccgttggggaatctgttggggatttgagatgcaaaagcgattcagtctgttggtccggaccgctcaattgattttggtccgacattgttggtgtacttgatcaaatctcctgaactcatgaacatacattttattgaaaatatattaaatgagggggagggttaccaatgtgtcagtgtgagaccgaggtgaggtcttggtgtccttttctctagatgtaagggtgccctttggaatatttccccggacctgttcttccctggtgacgaagattttcactttccattttatgagttcttgggggttttcaccgctccttcactgtcatggtaatacgtcgtgtcttgtttgcttcattcttcccgattgctttcctcccttggggctgggttcgagtctgaccactcgatgatacttggtggtgatttttattgagtagcacggttgtcgtccttttgagctggtggccattttcgaccccgtggcagcgcgcgctctgcagttcccgcatcgggttgtggttcttttgaaggggtcttggtcgaatagtcctgagtcatttggaatccctagtttcgcttatggtgatcatgatgtttggtatagcaatgctgaaatcatactctgctgggcggggttcccctaccggctgtgatattgaatttggttccactagaggttcctcgaggatgttgtcctcgggctatttccctatcgttgtgaggtaggttgcatcttgtgccgttcctcccatacgtggcgcatggatggtacctctacctgtttgacattagtttctttgttaggagtccgctttgatataccgagcccgaggaggttcccgaacggttttccaaggccctgctccgtggttggtgtggggtgcgggtatccgaccagatcttggctgggtacctgaccaagcttcgcttgaaacatcctggagtcatcaggcatgcttcgtttgaacttcgggcgaaggtctgggttgtccagccatccgaaactgggagcgatctcattcgtcctattagggaacgagacgcgacttcctttggtgcttcactcgctctttgtttggttccaggtgtgtcgggctcttttgttactacttcaatgacatcggtgtgtgctcctgcggaggggtctgctgatatggtaatcgggtttgtcaggccaggtgccaggctgcggcgctgcgtcatggtatgttttgagagtgtttcctcgaacttcctcaacgagacaggcttgaactcatcatcttggaagtcgctgcctttgaatgagcacgtgcaagcggtggtgcgctcgtagggatccaaggttctgtcgtaccttggggggtttcggcgttccgtatttccatgaagcaagtttcgggaccgcttcctcgggagacgattgctgtatgaactttcacgaacctgacccgatcctttcgaagagatccccaaacatcctcgttgcggtggggtcggttatcgatccgttgttgcttgatctctcgggtactcgttcggtgtagggagatgtttccggcgctactgtgctgggagtctacgggtaactttatagctgagtgatagccaactattgtgcctgcaacatttcaaaaataacatgaagactaacttcttgttcttctcgggccgggtttttttgagcttcttgttggtcgatatgttgtatgctaccatcgatgcgcaaggctccatcgacctgttgcgtgccctgcgaacctgcatatgctaaaattggtccagatgcattatcgaggttctgcggcgtcgtgccagccactggaacagctacgccgtttctgccgtgattttcgggttagtcgttctcgattttgctcaccgagccagacattttgacctgaaatcaaaggattttggacaagaaaaagtgtgaaagataatgtgcgtttgtgcaatgaagccatcaagaaaataatcactattatttttatcctcacggtgggcgccaaactgtttaccgtgaaaatggtaacaataattaaatttgtaaatgagattctaaaaatacgtgatctattctcgagctattgttagagcagatgatgctaagaacgtgaagtttaacgatgaggtgcgagctaaaatgaggcagtaatcaaaccgaaggggcctgttgcccggatgcaaaaccggtcaatggggacctcagggtcgagattcgagtcaagctcgagatatcaggggcaactgagaatgggataacaattaaggatacgattaaccagggctctttacgactgatattgagcaatatagtgaagaacaagtaagagaacgatagatattgaagtgacctcaggccagtaagaacgagcaagttagaaagaaaagagaaagagatattattgcatttgtggagaaatggagcaacatcagccctttacaaggtagggtgagtcccctttatataggagggaggactcggctacaagtaagtggagattaattacaaagtatggagatgggatggcttgacgtgatgccttagcataggctctggataggccgaccttgtcagacttagccgtgtgccttgggagcttccccctatgtcctagcttcggtctccattttctctgagtcgggcttcggcgagccctgaggtcgggaactcggtcgtggactcccgtcctcggggtcccgaggcatgcttccgaaatgacttgacatcgagaaatcaagtcttctgattttgtcgcgtacaagattgtactcgaagggttgtggattgagaagagagaaggcaaagaagaggttttgaatttggaagtgaagggttgtgatgttgatttatttatgatgagggaccgttctgaaacggcgacaaccttttgcttggggagttgtatcgttcagaaaaggtgtgacgctttggatgaaaatacacaacttaaacagactatcacgctgatgatatagaattgtttttgtccattttaaattgtgtatgaaagaacaaagaaactattaacctgtatcaagaaaaccaggttccctgataggtttggaaagtgagtttaaccccttttttagaatgcactgcaatatctgcttctgtaatcatcatgtgtatctacctgtgacagtataaaggtgattagacttatccagaaaacactttagctaacttttacctgagtatgactttcataaccaatcgtgaggaaccaggttctcagttgtgctttattatccccaatgcaaggcgattttcctcagactgttttcttctcagggctttggtgaagatgtcaacaacttgatcttcaacaatcaatgtatttgtccctcttgagttggactcaaggtcttccaatttgctgtttggtctacaacatctgagcacaacaggaggtagatgatacatattcggtttcaactgttgagagtgccattgaattttgcttccttgagcctcatgagacaagacgggaatccagagaatgtcccttttttgacgtgcttttcctatccattacttgaaggatagtggaggaccaggtcttgtgttcctctaagatatctcaaaattcttataacagccttcagatgagactcctttggatttgactgaaacctttgcacagaacccaattctgaacacaatatctggtctacttgcagtgagatacaagagtgatccagtgatgtctctatgaatggtttgatttagagtagaaccaggttcatccatatctaggcatgtagctgaggcaatgggagtgctgatgacttgagatgcttctatgtcaaaccccttttgacaactcgattttcagcttctgttcttgtagtcgtgggaccaggttccttgctggaatcaatgagcgttctccaccttgatcagtatttctattccctcttgggacgagtatattaggaggattcctccatctcttttaagcgtcaaattttcgaagttgatcctttccattgttgagaacataacaattgcacccagataccttctgatgagtcagcaactttggtcaagatatttgcaaaccctctatcaaataatattgacggtgcaaaatcttcaagagtcttgttcttcttttctacaactccatttgcttcagtgttcttggagctaagaagttgagtaattcttctttgaatgcaacattcatccactatggcattatctaaacctgttccatgatctgatctgatgcaagccatatttgtttctatctatacttagatcttcttgacaaaagccacaattacttgagagatctcatccttggttctgaggaataaagtccaagtggacttggagtagtcattcactgtcaacatatatatcttctttctttcctgtttggctctttcacttctccacatagatccatatgaagaagatcaagtggccttgaggtgatgactaccccctttttgggcttgaatggagatctggcatactttcctactgcacactttatgttccttgatactcaacttggtcagaccaagaaccaggtcctttagagccgatttattcagtgatgaaaaacttgcatatcccagccttctgccccatagttcagcatcgttttcaacagctctcaaccaacttgtatcaccacttctacagaggatcaaacacatcaccataagtattattgtgccttttggctacaacatcacctcactagttacaagatttgacattgtgcatatcctcgacaagaattccattttatttcccttgtcacatatcttccaactcctaaagtgtaccccttttagctgtttccaaaagggtacactctctccttgcaaggcttttagtgaaggaaagttgatcgtatttttagtcatgtgctttgagcaaccgctattcatatatcattgtaggtttctccccttcactgctcactgcataaggaaataaatggttagctttaggaacccaaataagtgtgggtcccttattatgagagaagggatgaatgagtgctcttttagtccaagtaggcattatacgattcctatttgacgaaccatgtcctctagcagtagttactttctcagcaaaaactttatttttctaatgagactgaaccctggccatgcagttttccttgaggtgcccattgttaccacagtgggtatatagccaattgtcggttacagtaacgtacttgctatgaggcttgtagggaattttttccctttgaaacccagtcccttgcttgtttaccccgctgttggtgtacatggcagtgatagcatcagaggaccaggtccacttaagcgatttttcaaggtcattttttactttccctagttctttctgaagctgtttgtttttctcaagttcagcacacagactagtctttaccaaatttaactcattttcaagcttaatgtgtgcatcacttgcaaatttctttcccttttcagagtttctaggcctattcaccatttttaattcctcaattatctctttcaagtctacgaccaccactactaggtcatctctctcttgctaggtttctttttgtttacttatacacccaatggtttcttttaagtccaccacaacaaccattacatcatctcttttatgttcgatactggcaattttctcttctaaggcattcctttcctttttcagattctctgttatttctttcaaatcaactacaacgactactaagtcatctttggtttgttcatcttcccctagttctatagtcaatgcatctttatcattaataagactatggtacgcatcaattagtacatttgctaatgacacgagctttttaggagagtaagattttagatttctctgaacatccaaaaaatttaccttatcgttgtcatcttcatcttcatcatattgagccattaaagcaaagattgaatcatactaagttgtttcatttcccactaccattattgaactaccaccatggttgatttcttcttcagattcactggaggagtctccccatacagcaagagcttgctttacaacattgttagcgtcattctttctcttgaagcgtttgttaggaacccgattcctcttagctgctttgtcaaagttgttattgtactaatcttgctttaggagagggcaatccttgatgaagtatcttgtcttgacacatttatgacaaaggtcataatttcttggctccctagaacttcccttttttggaatgcctccattcctgtgaaccatcttctggaatcttcttgtcaagtaggccatgtcctcgtcttcaccacttgagtcattgctgtctgtcttgaggaccaggttcttctccctctagggctctcttctttcattgtccttcttcttgttcttcatttcataggttttcaagtttctaacaagttcatccatggtcagtgtttgcaagtcattagcctcagtgatggcgttgacttttctttcccaagaactgggcagtacactaaggatttttctaataagcttgtttctcggaatactttcaccaagagagtgaagctcattgatgatggaagtgaatcgagtatgcatatcttggacggattcatcatctttcattctaaagagctcatattctgttgtgagaatatcaatcttggatttctacttatgttgttcccccgtgagctgtctaaaaagcctcccagatctcttttgctgattgatatactgctatcctattatatttatcaggaccaatttcacacacaagaattttttttccacgaaaattcttttctatggcctttctgtaagcgtcattgaattccttcctcatcttaggaatggctacagctgggtcaccaaggttctttgtagggacaaagggtccgtcacatatgacatcccataactcagaatcttcagccatgataaagtcgtgcatcatagttttccaccatccatagtattgaccgttgaaccttggaggtctctaagtagactggccttcttcgaagtttggaggagctgccatgaggatcctttctaggtattaacctgatagaaagaacctgctctggtaccaatttatagaatataagggtctaccaaactctatggagaaccggttctctatcaggttcaacagtacacacacatagcaataaataaatgacaagagaaattttacgttataaattcccagctcaacgggattaaaaaccacgacctacccttgtaggatttcaactttactactgagcaacttttagattacaacctatgcaacctaagaattaacctcttaatccataactaacttgcaacacacctattataaaccactttgtaataactctattacaaaaactttacaacatgactaactctagccaagactcaaacacataggtttaaggtttacagaagagttcctacaaaatgcttctaaacaagctaattaggaaatacaaatgaagaactattataaagttacaactcaactaagaacataaaatgacttgatatgggaactggtccatagttgctttgttcttttttcttgaagcacttgaaactttcttactggatagtcacgtgaaaagcttgagtaaaatctctaagtgttcaagtgaatgtgttttacctcccttggtgttaataatacatgtatgacctcacatacaatgatgtaagcaaggtaggtaaaaacccttccacagaaagttaactgctgcactattcctgtatagtagcgtgtgcaggcatcaactttccaactggagagttgacttcgtacagtctccccgggaactggtagggacctgttccctcagctgttccttccactctgaggagttgaatcatataccaagctggatcccaacctggaaccttgtgatcttaaggtcttgtatatgtgtaacatgttccttatctggttttggatagtaagtttgttagatcattaaaatataaagtaaagtacttatgaccaaagtacttgtaacctatcaaaactaaaattaaataagaatctaagctattggctagtgacaaacaatgaaaatagtaagcaaagaaagatattaatgggagaagatagggttgataggataggtgcaagataaatgcttgggatataactctagataattcacttctagtgttcaaacgagtctctcgaattagcttggttattaattcaattatttagtagaatctcttctctcgattaagtctcaacctcacaagatgaaccaatttaagctcgtggagatatgcaagaattcgtagtgggctggtctttaggagaacctctctcgattatcctcctaactaagtataatcaacaattcaactagcctcttccgattactaagatgaattaatgacttcaaccggcaaaacataatgcaaagatatcacaagtcatgcctctctcgattacattaacaagtgaatgtagatgcaacgattaaaacatccaaaacgattcaatacataaaactagagttaattatccacaaacaagtatcaaaataccaaatccattaaacgctaaagagaacaactccataaatatggagtaattcataataacaatgtttaaatcaaaggaaaacataaaacgaaccaaactcttgtcttgaatgaggattgaatgatgaaatccttgcgtttttgcttctccacctcctcttagcttccttaggtgtaagatgtgtcaaaagtcctcaaaataatgttttacgtgtatttatactaagtagggtcgggaccagacgaaaacagcttttcctgcacgaaataggattccgactctataaaaattgcacaggcgcgctgcatgggacgacgcgccatacaaggaatttgtggggaagttcagagaattgattctgacaggatgcaggaaaattgaataggcgcagcaccccacctgccgcactagtgttattttctctgagtacatatttttcttgactttttgatattcggacgtggtttttgacccccgaacgcgatcctagattaatccattgggattttacctagacttcaaagctcgaaataactcgaattcattttgtaatatctacatagctcggaatcctcatacaaggcataaaacacacaattagtgcaaaacactagtgataaaagttcaaactcaattaaagtgtagtaaattagagtgcaataagcgactaaaatacgagattatagcctaccattagagagcaagtcaatgctatcacggaggcaaattatctgcaaaagctgacgattgacgaactcattggaaatctgaagacctatgaaataaaaaacaagaagaaggaccatgtaagaagagataccaaaaagaagaagaacccggttctcaaagcagacaacagtgactcaagtggtgttgatactgacatggcctatttgacacagaggtttcagaaaatggttcgcagaaatagaggtattccgaaaaagggcagctcaaatagttatgatttttatcacaaatgtgggaagctaggacattttatcaaagattgtcctctccacaactaggaccattacaagcacaaaacagacaagatggtcaagaggaacctggttcccgtcaagaaattcaagccgctgataatgttgtgaaacaagcttttactgcatggggagattcctcaagtgaatatgagggcgatgatgaataaggagacacctccatgatggccattgaaagagaagcagtaaatatgactctatttttgccttgatggcaaaatctgaagaggatgaagatgatgatggcgatgaggtaaaatttctagacgttcaaagaaatttgaagtcttactctcaaaagaagtttctatctttagctaatgtcatgattgatgctaatgtcatggttgaagtcttaccctcaaaagaccttgttcctcagaacctaggataaaacattgccagtttttgctgcctttgtgaagcagattcaagtgaagatgagccataatgttgtaagcacaagatttgatcatggtaccgagttcgacaatgcaaagtttaacgaatcccgtgctgaaaatggtataagtcataatttttcatctcacagaacaccccaataaaatggtgttgtggggaggaaaaataggactcttgaagacatgacaaggacgattctaattgatagtattgtaccaaagagcttttgggatgaggcaatgaacactgtctgctatctgataaataggtgcatgatcaggtccctcctaaacaagaccccgtatgaattgctaaacgggagaaaacccaagctgacttacctgagaacattttgttgcaaatgttttgttctcaatagtagtaaggaagcgctgagaaaatttgatgccaaaagcgatgaagggatttttcttgggtattcttcacaaagaaaaacatacaagggctaaaacaaaagaactcaatgtatagatctaaagtattgaagttttaatgattagcaaagttaaatattgaagttttaatgattaacaaagtatggctgagtgttcaaagaaccaggtcctcaatgtagttgcttaattattctaaagaaccagctcttcaagagaaaggatcagtttctcatgttgataattatacgtctatacaagataataactttatctcaaagttacccatgtccgagtttggtggaagaatgtttctataagtgataaaggtcattgctcaagaagatacagataattcaatcagagacaaaagtcccatagattgtggaatccttggaatagtaggagccctgtcaaagaggaagctgactatgaataggactcctagaagatctcaagttgaagcatttaatatgatcgactttggacttctgaatcatccttttacacataaatgaaaaagtcataagttgtttacttaagtcgggtacttgaattgttctctttctgagtcagtctagtgaatgtgttttaggaaattgagttgtaatcaagtgtcataaatagttggtgagttggagtgagtgttttgctttacaagttagagtaaatcaaataggagtagtaggagtattggacagtatataattgtagtcttgtaattgatacattttggctcattgttctagtagagttggagttgaaaatcctacatggtaggtcgtggtttttgcaccttttgagccgagtgattttccacgtaaaaaaatatgtatttattttattgcttatttagtttacgcttaaggaacatggtaaataaccaagttctttagtaattcgtacgggcactcaaactattagtagaagaaagtatacatgtaatctttgatgaatcacaccacttaagtggaaaagaatcacatgataagaatgatcaggatggagagcattcaaaggttcctgaagaagtcattgttatggcaaacgggaaggcagatctaatgagtcgggtcaaagagtctagtgtagaagatgcagcaaaacctccaactgattcagaggaacctggttcctccattacaacaactgaagcaaaaaatagagttgttgatccagtgcaagacactcatgataatgaatagagaagtggcacttactctttcatagatgcaaataatggatcccacacggtagaacctgggtcctctcaccatgagactcaggtgtctaactggaagcacaaaagcttacatcgtctccagaatgtaatcacccctctagattcaggaatttagactagatcaaagacaaaaagcatgtttgctttctcagctttcttatctcaaattgagcccaaaaatattaaggaagctttgaaaaatgctgactggattacttctatacaagaagaactccactaatttgagagaaatagtgtgtggcacctggttccccgaccttcagatataactgttattggaaccagatgggtgtttagagacaagcttgatgagtttgaaaatacaacaagaaacaaggccatgttggtggctcaaggctataatcaagaagaaataattgattataatgagactttcgctctagttgcaaggatggaagccattagaattctcattatttttgcatctcatatggaattcaaattgttccaaatggatgtcaagagtgcatttctaaattgatatttgaagaaagaagtctttgtaaaacaacatctgactttgaatgctatgagcatcctgaacatgtatttaagttcgacaaggcactatatggcttaaagcaagcccctcgtacatagtatgaaaggttgtccatgtttcttctggaaaatggtttactaaagaaaaaattaacaacactctattttctaaagaaaagagggaggaacctgcttattgtgtaggtctatgttgacgacatcatctttggtgcaataaatgattccttgtgtgaggagtttgcaaggcttatgggaagcgagtttgagatgagtatgatgggggaactgaacttcttcctaggtctgcaagttaagcaaaccactaagggaacaacgataagtcagtaaaaatacattaaagagcttccgaagaggtttgagatggaaatttcaaagaccattgatacttttattgccacagccacacgtctagacatcgacgaacctggttcccctatgaattaaaccatgtatcaaggcattattagttcactcttgtatcttacaactagcagaactaacattatgtttagtatgaggttgtgtgctagattccaatcaagttcaaaagtatctcatctaaaagttgttaagagaaatatgaggtatctcaaaggaacacaggacctgttcctctattatctctcaggagataattttgacttaattggatatgttgatgatgattatgttggttatttggtggatagaaagagtacatatgggatggcacattttctggggtcatgcttgatttcatggggtatagagaaacaaaactctgtagccctctctactgtagaagctaaatatgtgctagatgctttctgttgtgcccaattgttgtggatcaagaaacaactaaaagattatggtgtgttttctaactatgttccactactgtgtgacaacacaagtgctctcaacatgacaaagaactcgattcaacataagaggacaaagcacactgatgtgcgacatcatttccttagggacaatgttgaaaagggtcttatctacatgaagttttgcaaaatagaggactagatagttgatatcttcaccaaagcattgagcagagagcattttaaaaataatctactggagttgggactaattaaattgaattgggaacctggtccctcaatgactggatatgaaggaatggtaaggtgaactgtgaaaaagtattttctagcaacttttaactcaattctataccattacaggtaaacacgcatggcaattactggggaaataagcagctaatgacattgcattttggtaggaggatgaggctcatatttgcaaaattagtcagggtacctggttcccttaactcaggttagtagttcctcttacactcgcacgcatttcaaactgctaaaagtgccacgccattaaaatgtgttcgccctttccccacaccttttatgcccaaaaatcacatccattacagacctacccagctacctagtctgttgcatccaattgtaatcggtccatcatttcctctaaatcacaccaaaagacatgtctctctcataactgtctacatcaaatccatcaaaccttcctcttttctttgaaaccctctttatagtgtctttattctaaaaagctcaccatgtcttctcagaaatcaaagtctcctaaagacaccattgacattcttattgtgccttcatctcacaaagagcaacaagctaaatctgagcctcaaccttcacgagtgaaacccccatctccgacaaaccaccacccactgtcttttccccgactctatcaagttctggttcccagtgtagccaaaaaaatcaaacatcccagaagtttgttgagtcaacttctccctctgctatgccaaaaaatggtagaagacggactggtaaaaggataagagggaacataggtttcaagtcagttggttgaggaagtaattgtatcccaaaaggttgttgctagttttggtgaaacatctggtgtatctaccacccctctgctccaacttttgatctaaatagtgtatcactattaggtaacacctctctcgcttctaccgattctacattgttggatgtgagtgaaaaaagccatagaaaacatgatgcttattgctattgaagggtgtttagttggggagtatgtgtctggtgatgcgatgtcacgacccaaatcacacatgttgtgatgacgcctataacaatactaggtaatccgacattcacaataaaaccatgtgtctttaaatttggaaaacataataatataagttcaaggaagaaatctcataaatattgataagaaataccgtgattaaatacaaaagccctcaaaatctgagtgtcactgagtacatgagtatctatacgataacatggtctgaaacactatttaggagggtagaacaatataaataaaactaagagataaaggaggagagtcaaggtctgcgggtgccaaagcagctagctcgataatctccgtactggtaaaaactctaaattagcaaccatcgtgaccaaaaatacctggatctgcacacgaagtgcagagtgtagtgtgagtacaactaaataaacaattaataagactaacctttgggctgaaagcagtgatgagctcaaccaatacagtttgaatacatagtttaacagtacataaatgataggaaataggacaaacatctcaaagaaaactcataatttgttcgtacacggtacatgaaatatagacatgcttacagttttaaagttaagctcaatacagataaaatatgccacgtgtgactgatatgaggaatacgacatctctatatctatatgccaatatgcatatcgtatgtgatgcaatacaatgaaaacctcacgtactcacactcttagagtactcaatttgactgtctcaatttttaacatgaatcccttacgtgttatgtggttggtgttgaggtgacacacatgctaggtgaaaggcatgtgggcgtgcactgtagaaaatgagatcggttgattcggtggtattgtgtagtcatcaaaccttgtagccattcatgtgacctctatgtgttagagtaattgagttgcagattcatattagaaatcatgttaggctatatgctaatcctattaagacccaatggtcatttatgatggatgtgactaagtacaaaattgccatctaagcaaatagttcaacaacagaaatgatgatatgcatgtagcacagtttatcgccactagaagtggtagggcagtctccaaagagcccattcttaaaagacccactactagaaaacagaagaaataaaaccttgaaaatgtgttgaagaggaataaggagaaaaagattggtgaaatggggaaaattagtaaatgaggaggatttgcccccagccaatattgtggatattgaggacgaagaggtgaatgagaaacctgctccccttgttcgtaaatcctataagaagtctgtgattgagaagcccaagaaaggatcatctgtgaaaggagttgaaatggatgaagagaagagtgttgagaagaaggagtctggtgagaaagctaagtctggtaggaaggagaaagcttttgagaagaagaaatctcacaagataaaggcaagtgatagtgaggaacttggttcctccaagaaggctagaatggaagtgtctaaagttgtctgaagagaaaagatgaagcaacaaaaagtgttgtggggcagagtgtttgatattgacattcttgacatgtcaggcatgagacaactagttgaaatttgcgagtttcagaagtggagtaatctttttactatttagagtccaaaagtatatgaagaggaagtttccagcttctacgctgatttgttcactatgaaggatgacaatatctacctgaaggttaatggaatggatgttatgatggatgaagttgtactagagagtatcctggatgtgcctactgagggctctcgtctgttgaagggacctgttctgccgattttaggaaggttattctaaagcctcaagctatttagaaaggggaacgagtgcacaaaaaggccctacttccaaaataccagctcatgtttgagatagtgaacaaaatactgctccctcgagtgaaagaacgttccattgcatcaatagcgaacgtgttactcctggaggcattggatggatacattactatcaacctatctataatcatgattgaacatatgcaaaaggtggcagacttcaaggatgggaatcataatttgccttatgggttcctgatcaccagagtgtttgaatatttcaaagtccccttggggagagcagctgtgggaactcaaaagcaatcattctcaatgagtaccttggaggagtgtgatgtatcgacaagaaggggagttggcagcaattatacggttttcagcagattgatgcttagactgctgctaatgaggagatatggaggatgaaggctagacattccattcttgagaggcagctcagtcaagctaaagaggaaccttgttctagcagtgctcagggtgcagaggttgcccgcttggctgctgaaaatatagacctaaggaaacatgttgagaacctgaaagagtagctgatcaatgagcagcggtctacaaatgctctagtggatgtttttctcaaagcccttgacccttcatccttccctactttttcaagtgccccttaaacagtctccttgtcagtgtctagattatcaatgcatgtcttagtcctagtgtcctactttgaattttattcttatgactgtggtactttagtttgtttattttgtggatgttttttaacaatggtactactactgccaatgtttttcttctctcttcaattaatgagcagctcagtcttttgctatgcatgctttactcttgtgttatgtttttagatacgttgtgtgcacacaagtggcatgagttaactttgctggacttctttttgcgtttacttgaattaatcttttatgatgacaaaaggggggaaaaaaattgaaggggaggaacaagttctcagggggaatatcaccaaaaataggttctcagggggaatatgactaatctgcagggggatccaaatggagatctaattctcagagagaacctcaattctaagtttgtcatcatcaaaaaaggaaaaattgataagttatgtgcttttgtgttttgataatttaacaaacctcatatgagaactagatagggaacctgatacaaagcctcaaagtgctcggaacaacaagtcacatgtctggcacaagttccaatgatatcagtcaagggaacaacaaagggaatagatggatatcggttcctcctgtcacagtacaagtcaactctttatagttgttaaagctgctgcactataaacgcaatagtgcaacagtcactgttgaagcatgctgtgtaccggatacttgcttgcatcatcctagtcacttcacttatatattatcaacatgaggcaagggattacacacacttgcaaaccctaaaatattattttctctcaagtgtgcattcgccttcatttactcaaagacttgaagaacaaagaagcaacagaacaaatgaccagatcccatcattgagttcatcatatatccttaggattgttgtatctttattaatgttattcacttgtaattcctactcagcttagttagaaacatctcgtaggatatctttgtaaaccataaacgttatgtttgtgtttgactagagttagtcaaagtggtgagctttgtaatagagttattacaaagaggcttgcaatagagctattacaagcaggtaaaagattaagagtttaattactaggttacaatagtttgtgatctaaagttgctcagttagtgaagttgaaatcctacgagtgtaggtcgtagtttttaatcccgtgagctaggagttttccacgtaaaatactgcagtcttatttatttcctttgtgtgtgttctgtgggaacggatagagaatcaggttctctgtattgtttggtggactcttagtttacagcatatgggcatgaatattgtatatcaatgagtattgtaaccatagtatgtattaaaagctctcagggtatattagtgaagtaattgtcttttgctatgacccctagagcccaaactttgcttagattaactttgtcctctttttgtcaagacgattacgataaaaataggagccattgaacattatttgaatggaagaaatgatttcagcgctctgataaattacttttgatcattataagcattagagttgtgcaaccatatacgtcgcaagttgtgccttcttaacatgaaaatagagtaaatatctgaaatataaaatgtaagaacatagagtagtttacaaggaatattaatatagtagttttacgtattttattttttaaaataaatgaaaaatagctcaaggaggcctttctaacctcgatgtgttaaaagggttaaatactgaaataccaaattatcggatgatgtttcattttagtttgaattaaatgttatatttcataataaatgaggtcatttttgatatcttgaaacttctgctaatgactatatctcaatatgggtactaacttttgagggcaagattagttgttggttctattcaaaaaggtcaattttcggaatttaaaaatttaggggagttataggaaaatttcgcaattatattatttaaaatagagtgatcaagatatactcaatattttgaaaatctgaggagcaaaagatcataaagcataataaagctttgatattcaaaagaaagctaaacgaaaacaagagatgtatggaatatcaactttaacaaatattttaattgttgagaatgaaaaaacatgttgaagtccaatatgaaacttattcaacttagagacatgtaaatgcactcataagatagttacacattttttcacgagcaaacgaaagaatatatgtaatattcaattaagtaaaaaatatatatattcaactaagtcacacaatagaacatttaagaatattttgcttaaccatgacaataacacttaattatgataataattggcataagtacaagatatttgacttgatagcctaacgatttaatgaaagatttattttagaccgttctcatgacagttgcatacacgtccaaagtaaaattaaggagtgttcattttgaatcgtaaaactatctcaatcccaaaggagtaattaacctttttttcttgataaataaacattttttgtgggactaaatttgtcctgaaaataaaatatagttcgaggggcaccatatatttgttttgtttttaatttttaacccatatatttagtgtatattttgtaaacaacgcccccctttgggtttggcaccgtctcgagatggcggaagaagtcgtgggagaagtagaagcagtagaatcagtttacggcgatgattgtttactccttcaaacttatcctccttcttttcatctccatatcagacctcgtacggctgatgactcttctcaacaggttccctctcttccctaatttcttccccctacccaaattactctttgtgggtgtgtgttttattatttttaacaatgaattggcttcttgaacgatctttctgctgaaatccttatatttagtgcgtgtatgattttagtataattgtgtggtattgtaggatttaggctaattaattacctgaatgtgaaaactcagctttgtatgtctgttaaaagagaattatgagttggggggaagcggaaaagattctttttttggttaatgaatctgttttctaatttgttgattgggatacgaacattaggagaactgacaccctaaaagctagctattgagtggagagctcaatgtcgtataaacctccaattgaaatctggtagttttctgtttgtacgtgtcatccttgcatagtggcgttgttaatcttctctgtaccattccctccaattttattgccttgatactcgtgctgaagtgtcgaggggaagtgctcagcttgagcttcaagtaactccaggacttaagcacgctttaaataaagcctttgacaacactatgacaacaactacgcctctatcccaaaagagttggagtcaattatatgagttccatttaagctcgttacagacaagcctttgttgcctagatcgaaagcttaaagcattaccaaaattctgtccgtttagtcacaatttggcgggtgtaggaaagtgcagatccggaatctcatagagagattgatagaagaataatgttctatacagattatatacacattatgcatgcagtgactaagagggaattggttttggagtagttcgtgcttcctaaggctgtcaatatttgctgatattttcaaatgaatctgatgaagtgtcattatactttacagttctttttgttctttggttttctggttactttcctattgttttatgttgtatgttgctatagccttataaagaatagttacattttttcattctcctgtcttgcagtttgtggaagcaatcatcggaatccaggctggtccaaaggtactctgtcactgtgattaatattctttttggggttgttgattatcatttggttcttttgttgtctaattcattcgcgcttaccttagcgaatttcatgtccattttcatctgatagctttgtgcagtccacccacacttgcgtcccatttcatctcttatttaactagttcatgttactattacggttgctactggagctactaatgaattgtcttttcttgttttttatttccgtctttctgagccgagggtctatcggaaacaacttctctgccctatcgtggtaggggtaaggtctgcgtatacattaccctccccagaccccactttgtgggattttactgggtagttgttgtatttaactagttcatgtgatagccatacttgtatgattagacaggtttcacatttctttcctgcactgatataattattttggcagtatcccgacgagcctcctgctattagaattgttgattccaagggccttgatgaacaaaggcataaacaattgataagttgtctttcagcaagggcttgtgaactctcctcgtgtctaatgcttgtagcactttgcgaggtaaccattgcaatgtccagatccagttctgtgattgatgataatcctaattagaatactctcttttattaaaacctagctacataatctcaagacttgcattatgatgagtaactattactttggatctttttgtcctgaaattaagtcaaaaggaacaggttttgtaatttatctaaaagaagagaaactcctagggttttggttcagccataagaaagtacaaccatggtgtgtgggttggactcacaccacgagttcgaattcttccactgacaggtgtctggtagttaagtggtaattcaaagaattgtttgtgtcatttatatataatatagatttatgttagaaactcgagctttactggtattttaactttgtttagcggcagggtgctctgtttctttctgaaagcaagtctgatagttaagtggtggaattaattatgactttttatgggctgggattggattatctacttgtcgaactattgagtaaaactcttatatattgattgtgtcagggactcacatttatgagctaaacaactaagacaatgtgttgctaaataggccaaattactattagaatctgggttatttatagccggccatattttgttgtttactttttctggccatatgcattgattatatacaactgtacacatataatatatatattatacctccaccggctatttttagtttaagggattgggagagcggctatttcagttaattcttcttagaatttcagaagggggcttaatttccagaaagctgatgctctgaatgtattactaggaagcagtggagcagctttccagcatgaatcaccctgatggggagtgtccattgtgcttgtacccattagttgatgaagatgcaggaagctctgcgccatttatgaaactgatgtcttgttttcattgctttcattggtaaattctgtcagtagtacccctttattttgattaatttgctactggctgaaagatgcatggttgtaacttcgtactcatttatttttcttattgctgcagtgagtgcatcatcagatggtggaattggcttcaactattaaaagaatctgatgcccctacggactctggttctgcttcgtcttctaggaacagggatcaggatggtccgtcgcaatgaaactgatgcgttaagatttaaatgtttcatagcatactccacttccattttcttctcttggtctgactagattcagaaaaggttaccttaattttattgggaattaagataggtctttaggatgatttctcagatattgccttttcttagataattattgatatgaagattgttgagcatataaaaaaagttgtgtttggacatgttggaattagaagaaatctctttaaagttagacccctttactccttcaccttgccctccaccccccacccccaccccccaaaaaaaaatgaaggcaaaagaaagacaataggattgacggaatgcataagatattctgtggggtaaaccagttacttgagctcaaccatgtgtcgtgtcaacttttgccaagggatttgatttttctttgctcaactcacctgactaatgagattccgttgaaataatgcgtgcattcacatactctgtcagcatacctggtctagttgcaagatgttatagtactttcacttatttcctatgttgctcggactctctgaaaatatcgatgggtgcatgtcagatccgacacgggtgcggcaactgttttggagagtccgcgcaacatagcttatttcattagaatagctacttgcatcatttggtccaagaggctctgcatccactaacctaggggctagggcatcccctgtcttgtctcttctttctgcagagaggatgaggtttttatttgattctgccttccttctttcctgtccgtttctccatcttatagattaccaatgagtcaacttatttcgatccatttcttttccatcttttgctcctataccactcgcagtggttataccaaaaggtttctttttgcttgcaacctcagtttgtcgagtactaatttgatatcttaatgcttcaccgtaaaagccctcatgctttgaggacggggtaaagagatttttgaatttgttttattatttttaggtttctactttttaaatattttccagatggatggtgtttacagctgggggttttgggggacaaccgagggagaattttatttttatccatctgtgctcttttttttgcagacatagtttcccaacatttctagttccctagctcactaattatcttgcttggtgatgtgtgattcaacagaagaagatgtggggaagtgcccggtttgtcgcaagtcttttctagcgaaggacattgagcacgtgctagacttcgtgaagactcagcatgctgtggtatgttatgaaagtatcttcttttttttttttaggccaactcatatcttttccctaatttctaggtagagaaaatactttgatttgctgaaatgttataaaagctgcttttatgagaattcctgatttcaaaaagaaaaatttcctctcttacttggggcaaggaaactcctcatgagccaaaagaatggggaagtgtcattttttgctccttgttgtgaatgtatttgagcatccaaacatagaactccgttggatgtccttatgcatccgatgtgatgtattatgtatttgtaacaacctgtcacacatgtaacctaattctggggttcatacctggatttgaacgtagacttgagatcgtcaggaagggtttgtcaaaagagtctcaaaaaagagtttgtaaaaggtattgcctactaaaagtgaacaaataaactaggagactcgatatgctaaatctgaaacaaattacagttggttagtgcccttggttagtactaaatggaatgaagtgtttgtttttggtatagttacaacattttgttatttatattggaggtagtctggtagagcgagtgatatttgttcatcttttgaatccagacttccagtggatctgaagtcaacaatgaagacaagattctttcctcggactcggaaaaactaagaagaaagaaatttgatgctattctgaaactccagcaagagaagggtggcttaattgaaataaaaaagcatgaagtgttgcggccaggtatttatcttccacaacctgctgcattaccctcaactgcacccaccgaagaggcaaatgagcaaaaagacagagatctggcagccaaccccagaccaaattctagtgcttcctcaaacaaacctagtaccagtagagcgagaaactccggcacaaagaaaagcaggggacacagttcaagaaaacaagcgactcagtgggttaagaaagaaaatagtaatacagcatgatatgaaatctgtattattttataagaacagctgaaaggaaagaaaagtatcattttttgtgattgtttaacgatttgtttacatggtcaattaacatatcaatatcaagaagggttaagttgtggtataatttgggaaatcaaggaagttggcagataggttggtgccatctactctttattgtgctgacagtgtcgcgatttgtctcactaggtattttcttcgatatctttctccgagacaatatttgttaagagttttcgagaacaattgcttctgtcttgttccagctctaaactgaatttggggcaatgctgtgctttcactataaattttattgtgtcagatgtgactggagagataaatctgacttgcagctctaaggtacgttttgctgccaaatcatttggaggatggtctggtaagtaatcagtgtcaatggttttaagagatcagacttcaaaacggagaaaaagcaattttatttgtaacatgattgtggcaagaagtaacggttttattttttcaatcaccataattgtagtactttatagtttatagctatcatttcatgcaaaaaaaaaaataaaaaattattcccctttggtggagctagctattgctcctctagtgactcaaacacatgaccctggaattgtaggtggtggccggagggtgttgaccatttgcacaatcccctcttgttgattcatgtttaaaataggtagttaaatgaccgctttaaataggtctatttcatatatctaaaccattgcaaaaattgatggtatatattgatacataataaacatgccaagtcacaacagcataaaatataatttcataaaaaacacttgtcgcatgtgcaagagttcaagattcatttgctgtaatcaatcacttattcgtattaattccatgcataaaattatgtgagaaacatgctatttcagcataaaacaagctgtgaaaggggttatcactcatggtatttgtgttgtaaaaaagtccaaaccatcaaattgaaaacatgttagaaggtcagagtattacaaacaacgtcactgagatcatatatttcaacgatcctcaatctcaactctaatcatgcgtattacgacatataaatatgcaacttaataaaagcgagtcatgtggtttagtgatcactcatattacgacggcccttaatctctcttacgcttgtctctaatgaccaatctcaaacaaattctcctacaatgtaggggaagagacatcaaatagggaactccaagccccttaggttcataacttaagtatgcagtgtttataagttggttgtataagaaaaaataaatcctaatcatattatgctacgattttttttttttttttttttgggtgcctcacgtatcttggtccttttaggaactgaacaagtataagaaccaatattttaaaaggcgaggcattttacctctgacgaggcgaggcgtaagccctgagacatggggctaagtcccacggatctttaaattttactaatttcatgaattttaagatagtataaataaaaaatagttataaagactacattgaaatcacaaaattataacaactaatctatttaaaatacttataaattataatttgactatgaataatacgaaaagtatgacatatatcataatatgcaaattagctacaacgtcgttacaactcaaatatcaaaagtaatgtattcgatacaaaatcttatatgtatcttttaatgagtaatgaatcttgaaagaatttcgatattataatttgatatgtttttcaaaacactcatttcatttaatatgctttctatttgaaagagaatttatataaaaacataattcacaatttaaatatgattctctaacatcatttatttttaagtttcaacaagttaataaagtgacacataatttaccgtacaataccgtgataactaattatttgtaaatagttacgctagctaataatgagttattaaattaataagtattgtattttgtaaacgtgaaaaaaatactatttagaaaaataattataaaaaaatttatggactattatataataaagacataacaaaagttaataaataaatactttgaaagatttaattaaaatttactatcatagcagtcttagtagataacgtgcaataatttttattttaattatgacataaaatactctcaatttaataatttatgattaaaaaaaattaattttgagactaacacaattgtataaagttctattaagcgagcccagtacgctaggcgttgggtgtgtccggggcgtaagccccaatagccgaggcgtaagtctcacggaactaagccccacacataagttcaggggcgttttacgagtgttccgtcccggggcgagtctcaattctgccttttaaaacagagatacgaactatcgtaaatagtttagccaaggattattcatcatataactccatatcaaaataatagagcagaagtagaaagattaatcagaaaggaagttagaatattccaaattagtttggcataattagacacaaagaatgaagaataattatgacatacttggcatctttactttcggttagaaggaataacacgtagcctcatacgaattccgaagtagcatttcgacttttatccctgactaatgactaaattaagtactagtgtactaatttttatatgacgatagccacctcaaatattttaacttatccagtttatcaaaacttgcgttctaaaatagctgaggtttttcacttttataacttgttaaatgaggattagcatcttttcgtctgcttgaatattgacagtacgttgtgattatattatgagccaacattccatgcatgagacccaataacggataggatttaggatccaaaaataatactgatgattttcagtagtgatccttttatgtgaagttcatggaaccttaccaactttatggggatcactttgtaagttaacccaaaaatagagcctaaaattggagcataccttttattatggatattcttacacgatctaaactacatactcagattctcggtcatagtttcgatgtgaattctttctttagttaaaggaccttatgcctatctctctttcgataaaatatttacgtactcctcttttcacaagaatgatggctttcaatgtatgagctaatctcaaaatattggttgtctttgtgaatttagatatcttacctttatatttttttttaaaaggaaaacgtccaaatattagttggctttcgatgtacgagctatgtctgcgatttgtattacatttatagttatctattatattggtccataaaagccgtcatcattatcttttgtttcaaatatgcctctcccactaacggtttcctcctgtgaaaaaataggtctgatttggttgataaggcgaattgttcaggcatcttttaaattattatagaaagtatatataaaccaatttgatagtttaaaatcgagctaacgaaagagataactgttgcaaatgcatttctgaaagagccctgcatatcaatccacaaaggataatgttagatcttgcattagaaaatatgttattagaagcaaaagtagaagcacacaaaaatttcaggacataaatacaatttaatcgactattggattattaaattagttgtcatttttgtgttaaaaaatccaacttttaaagagtgttacccataaaaaattaactttttaaataattttgatagtgtaaacgagtttacactgtacataagtaattataaaactttattgttgtttaaccaaaaatgtgattctttggtcaaaactaaagacaaatagaaattcgggctactgataatcaggagacgaaaaagaaataatagacttattgagaatgacaaataagcagtaaataggtttgtattccaatgtaatgtttttgatctcctccccccttacaaatgacgagacctcctccttttatagttgattctaagtaaaggagtaatacattagtcttaatgagataattatgagcaataaatgatattaaataagacgttacacaatcattcctatttaataccaattctctaacgtattgagtatttaatattgaatttggactccttttcgtcatcatatccacgtcttcaatgtcttctgatctcttggctttaaatgacctaaataggtacgtaacttgtattattcgaattgcctcttgtgcctatttagctttcctttccccgtatctgttgtcactcgtgcctcttaactgatcatcatgttttgaccatttgaccagtcctcgtgtcatgccacgtcaccttcaatgtaaattcaattttttcccaatacagatagtccccctacttccatttatttatcaattaaatatctgggaagtagatcttcataaaaagggaatttttgccgtaattaatactatgacagtactaatgcttcaattaccccttataattaatgctttgcatacgtgtcaccttttatttaatgctctacacacgtgtcactttctgattggttctgcaattctgcacccttttttcaaggcttcttcattctcactattcacgaagtgatagttgcctttattataggttttccatcattacacttctaagttggacggttgtcattataaacatatttaaccctctttcttttgtcttcttcttcatagatcttcaacaagcaatttattattcacttttgctttttctcccctttagttcatccttcttcaacaatgtcatctccaaaccctaaccctagaaaagttccaattctagatcacttccccaatgcccccgtaagacataggagaggcagaggaggtaggcttcggagcttgagcctaggatccactcgtggtggttcatctagttctgcttcttcttcttctggtattaggagttctatcccaaagaccccctcttctaaaggtaaagaactttctaaacctactgaggaacctttagttgaagaaatcgtacccaatgatttatcttttgggaatgatagaagatctctccaagaacaagttaaaaatttagaaaaagctgacacctatccttctttaataactgaacttgtgattcccactgttaggaaagattgtaattggagagataatcttcgtatgatgattcctgccccaaaccagagaatttcttctttcagaattggattctctttcgtttatacttatccctttactttgggatttaatcctgccattgacccagttatacttgaattttgccgctttttcaaaatttgcttagcacaagtaggtcctcttgtttggagagttgtggcttgcttaaggtatttgtctaccaaagccaatgttaattttaccttttcccatcttgttcacctataccaccccaaattattctgccatggagtttttaccttgactgcaagaagcaagaaggttttggtaaaccccgaagatgacaaggatcgagggtggtattgtcgttacgttgctgtacgtacggtggatttgttgggtgaaacaaacattcccttccctgagaagtggaattttgcacgtaagtttttctttttcttaccgtatctattttttaagaattttgattttttttctaatctcgtctctttttggctttttgtagcaaccatgggagatgtggaacacgttcctaactttcgtggttgggtagattcaattttgaagattgcgcctatggaggcgagaacttggaaatcaatttatcttttgaatggttggaaagtgaagacccatggtatgtatttccttatgctttgccgtatattgaattctttattattttaattctttatccctctttttatcaggatttggtatcaggggtatgacagctgaggtaaccgttgccattcgagtgtcttcaaccgcttcacttgatttggaaaagactcgggccacgctaccaaaaagaaaagttgtagaagaaagttctgagaatgaggaagaagagaatacctctttgatagctaggccaagagccaggagacgcatcattgatggggatgaagttgaagatactcctgctcgagcctttatctccgagcctgttcaaatcctttctgatgaggataccactctaagaggctctaatgaatcaattcgacgtctctttgttagtggttttgagagtggagagtttggaccagttcttgatgaaactcccctctcttcttctattcccatttcttctattccttctattcctttgacaaccacgagtatttctttgcctattttattgactcatgtttccttacctgttttggttcccatatctgctcctactgtccctgctttgactcccacaactcccattgtttttacctcttctactactcctccttccattgttccccctccctttgtttagtatgcagaggcgggttctagcagcagaggcatggctatgagaagtgttactcttgaagttcttaccaatcatagccttttgagaaagactggtggagctgatatttggctcgagcctctaatcggagatattgagaagaagaagatggagagccacagttgcttgactttgatgaatgacatagttcattctaccttgaaggtacttctctttttaacttacaagttttttttatctctttatattctcacatttgatgtctttcccttgtaggctaatcttattggtactgagttaatgggaagaatctccactctagagaagaaggatcgagagtctgcgaaggctatctctgaggctaggagaatagccaaggaaacccagcttgaggcagcaaactggaaggagcagtttgagaatgctcaggggaccatagaggagttgcaagaaagtagaaatcacctggagcagcaaaagcgtggtttgacttctgagctagcaattgccaaggcttcttcaagccaatttgaaaaagataagcagcttttggagtgctcattttcagaacaattatcaaaggtcagtggagaaatcagagagcttaaggcacttgtggagaagaaagaagaatatgcaggggagttagtgcaaagcttgactcaagctcaggctgacttaaggatctcctctgacgagatacgtgctttgaagagttctcatgcctcccttgaagcttcccttaactcccacttagctgaataccagatattgaagaacgatcttgctatgtgggaaagggagtatggacttcttgaggagaacttcaacatagaggtaagttgggcttttctaaaatctcgtcgtgatgctttgatggaagctactcaagaaaactttgaattgcaatctgaattagccaaagtcttagacactattaaaaaaagccaacaaccagttgatactccttctcctgcacttggaactcctggggcagaagagcttttaaatgaagaagtggctactacggcaattgaagttgcaattccggctcccgggggtgaaacttttatgacacagtccaaggaagctgaagctcccgtgactcttgcttccctcggtgattttaacactccaggcccagttgaaaccgctcctattgttgctccctcagaagttgttaccgtgcctgtgactgcccctgaaaatgagattgcaacttctgatgttccaaccccttcagtgactagttgaatgtatttcaaactttactgttttttttattaattagtggtgttatcccttggcaactttaagggatcttttgatgaagtccccagttatcataatggggcatttgtaaaaaataaatattttgctgactaagtttgtacttagtcttttatattatgaagttttattggtacttctgtatattctattcttgcctatttatctaggacttatagaatagcttagcatttttatcctttgaaaatgctttatgatacttgtaagcacgtgatttttgccctatatgagaaatactcccaaaaaatgcaaaataaaatgattttccttggtgtgcaattttgagtatttttgtgacatttttggattattatttgtatttgtctgtgtttgtttatttgctaaattaataaaaaatacaaaaatatgtcgcatttgcatgtaggatttaattctataatttttagtaattaaattagttttacaaaaattaaaaaattacaaaacaatatgcatcttttgcatttttagcatttaatgtccaaatgaacaattttatgcttaattattacttaattgtgcgttaattgttagtggtagtaaattttcgcttttataacttaatttagttcttaataataatttaagtatttttataatttagttttagaaaataaaagaagaaaagataacaaaaatacaaataaaaatcggattgggccacttcttcaattttcaaccccaggcccaaacaatcttctccatgacccagtccacttcagaccgggtcgacccagtccgccccatgacccaaatacccaacacccctttttcattttgtcaaaacacaaaacaaaacaaaaaataaaaaaacccaaaaaccctaaaaacctaaactaacccatccgccccttcgctatcttcttcttccccaaactcaaaaaaaactcctccaaagctccaaccaagcatccatggctgcccagcttcccgtcccaaacaccaccaaacgacacaacctccttcgcattcaaacgaccccagccctatccgccattgatgaagctcgtcgagctcaagcttgagctcgacgtccatgtcgctgctgcttctgtttcaaaccaaacaacctgctactcctgccttctacttcatcgtccaaacaaccaaacgaccacagcctcgacgagtcagctgttgttcgaagctcccatcgccgctgctcgtcacggccaagctcgcacgctgccatcgggtccaataccgtttcgccatggacgtcgtcagttgcttctgcttgctgcgtcgaccagctttacggcttcatcttcaccatggccaaacgacctccgttactgcttcgcttctccgagcttgggcatcaccatggccaggttgtcgccggactgctgctgctcaataatattcaagttctgctgctgcttcgcttctccgagctgcttctattcatcacttctccttcgcccagctgctgtatcttcagacgagctgctcgtttgagttttagtcgagatcgtcgagcgtcgttttgagttcgtcaagtttacaagggaggtgagttcgtcgttgagtccggacagatttattcccatttgagttttgtcaaaacagttcatacatatgtcgtgttgatccggttagtagtttttgaattttatgtttgtccgtattttgttttgatattttcgaatctaaaatcggcaaatgtttgttttgtttatcgtttgaattaatgttttgttcatgttcatgtgttgtttgttaaattaatttttcagatttcaaatgaaggattaattagttatttttcatgtttatttcatgtttgtattgttgtttaagtgaatatttgttagttttatgtttgttagattcaaattgaaatttaattaattatttcttcaatttgtttcatgttgttatggattttccagaaaatattaatgttgtttgaatcgttagaatccgtcatgtgtgttgcttaaaaacagatttaattcatgttcatctttgtttgaagttcatgtttaaatccagcgatttaatgtgagtttatgtttgttttgatttgttagtttaatttgaatcatgcatattgttgtttgtattattgtctctttgttcatccattaatgatctaaattaaccaggattggttcccgatatggttgatttatttccattaatttggaattttgtgttgttcatcatgttcatgtaaattgttgttgaagattgttgagaaattggtcatcttgactatattttggtcaagttatgattaattgattgtttagagaagaggggtaatttggtaaattgcattgcattcgggggtagatttgtaattgcaataaggtcggaggggtatttggtaattgaacattattttgattctttatgttaagcatgggggacaaatataatggggtgggatttttgaggtatttgtttaatataattgggtggggtttttgaggtatttgtttaatataatgggggacaagacaaaacataatgaggaggaatcttgtactttttttaatataggcatgggggacaaattataatggggaggaatcttgtacttttttaatatagacatgagggacaaattgtaatgggttgggaatgtgttagttatttaatgtaggcatgggggacaaaatttaaaataaagaagacatttaatagtgggccaaagcatgccattgggggaataattttggggttgggaatggaagacttgtcttgctatatatagaggactattcttgacattaaaagggaggagaacttgaaccttgagaggatttttttggagagaaaaaagaagagagtttttagaacttgaatattaagagatacctgagagagtttgtgagagtaaaagagaaatccaatttgaactttcactcgaataatttctgtttgcttttcttcgagtgttattcaaaaatccgaagctactgcatctcgtgtcttttctctcttctgctttgactgtgattgtacttttttcactgctgagttttcaatctgtcactgggttattctactggttgttactggttttgcggtgttgcggaacctgctgttgctgcgttattactgttgctgactcctacttctttgttcttgtactgctgtttccaggtacacatttgtacactcttagcttgaagcgaaaaatgaaatattaatcaggctcctgttcctgttgaattcttttgtttggatctgtgtttgaatattaattttcctctcttcgtataaaaatgtagtcgattaattaatgagtaatgaggttgcatatgtatgatttcttcatctaataatgctagtttaaattatttgaagaatagttaatcggctttgatattattgtgtatttatctcatgttctagcaaataataaaatgtggaatgaaagcagtttttccttgtacaaacgcgatcgcaattttccgttcacataagccgtaacttaataactaataagttgcgtttttcagcatgtaaataattaggagatttttcttttattttagagacgaacttaatagaaaatgtagtcgctataggtttatccttttaaaataaaaatgagacgagcctcgccaaataaatcacaaaccgccggggccctcaataaaatacataaccattgactagactttggatttggccgtttaatgaaccttcacggcctcttcctaaaataacaatacgttagactctttaggatgcgccttaataaattttaccttcttaaactcgggtgcacatttatgtgacccaaatccaattctcaacggagtcgaaatgtgtttctaatcacgggtacattgattgtgacgtggttcgagatgcgtgtccatgacgttgcaatttcattttaaaaaaaataagaatgagatgagcctcgccaaataaaatacaaattgcggggccctcagtaaatatttgctttaaaaattgtttagacttcgggatggaccgtttagtaaaattccacggtcctacccaaaataaatacgctagtcgctttaggcgcgcctttaataatttaatttccttaaacttgggtgcacattgatgtgacccaaatccaaatctcaacggattcaaagtgtgtcgacgaccacgagtacattgattgtaacgcggttcgagatacattttcacaacgttgcaattcttgataaaaacagtaaaatgataaaagcggttaaaaattaaattttgcacataagttcacacttgtataaaatcagataatcaagccgaatataacagttgagcgaccgtgctagaaccacggaactcgggaatgcctaacaccttctcccgggttaacagaattccttatccggatttctggtacgcagactgtaatatggagtcattcttttcctcgattcgggattaaaattggtgacttgggacaccctaaatctcccaagtggcgactctgaaataattaaaccaatcccgtttcgattgtcctttaattggaaaaaactcccttgcgcccacgcgggtgcgtaaaaaggaggtgtgacagctctggcgactctgctggggactagacccagaaccactggttcagggttaagaattcgagcttagaataattgttattatctggctttatttattatctgattttattacatgttttgagcctaatgtgctaaatgctgcttttaccgctttgatattatttgaactgtacatataaactgtgccgaaaccattcactccttacctccggggagaagctcgctggtcgagactccctattctgttagtgtcaatacctgaaaataagaaagaggccggacaagttacaaagccggacgatcccgcgggtccccggtacgtagccccctcctcgactcgagttgtccgctcgggtacacagtctagaacaaatacccaggttatgaacctagaataactcaacttcatgcctgatccctagtaggaacgtttgtttgcatcacgtgcatttgactttggaggctcaacacaggggttgggtctgtctaggacaagtgtaccacaaatggaaatgaccatcctgatgcatcttacttgctactacttgcgcatttatttgatttagacttgtgtgttgactgtcttgtgaatatcaggaataatattttgaaatgcgaaaaaaaaggaaatagcggttagagaattgattgcttatttttgaataaaaccaaatgcccaaatactgtcaaaactctgccggaattttaagaaaatgagaaaaaaatgtttagtttgttttattaaaaggaaaaatatatataaaaaaatatcacaattgttctgttttgtttttcaaaaaaaatagaaaagaaattgtttttttatttgtttatgaaaatgcaaaaataaaaaataataaaagagtctttctttatttgtcacaaatatatatgtatatatataaatccaaaagttttttttaatttccaaaatatatatatatatatgtctttatttgttgcaaaaatatttgtcttgccaaaaagtctagaaaagtttttagacccccaattttcaaaacaaaaaaaaaatccaaaaatattttcccattatggacttctttagaaagtctttctaatttttttttatttttttttaaaaataataataataaaaatatccgaaaatattttgattcttctttcaaaattgaaaagaaaattcaaaattcaaaaaaaaaacatttttagaagcatttcttttactaaaaagtaaaattccaaaaatattttctttttctttagaataagaaaaaaaaaacgaaaattcagaaaaatatatcttcctttcacttttgaaattttcaaagtttaaatcaaaagaaaaggaatttttacaagtctttctttcaataagaaatcaatcaaaaaaaatacttcttttcttcttttaaagtagttctttcgcaaattaaaaaaaaaagaaggttagttcatctacttattcttgactgaccgaactacgcgggtttgattctcaccggatgtgagatacgtaggcaacccttatccggtccaaccccaccttttgctaaaaaagcgaaaaacaaataaataataataaaaaaaacaaaaaacaaataatatgtcaaattttaattttgtcataaagaagtcgggtgatgctgttttgtcataaatagccgaatgttcccgaaagggacgccggaaggctgactttgcataaacagccacctttgggtcattttgagatatggacccacacagcctaaaaatcttcgtccccgagacgttgaaaggccgtgtttgtaatattgagttttctaatttgaaaaacaataaaaagagtcataaagaagtcgggtgatgttgttttgtcataaatagccgaatgttcccaaaagggacgccggaaggctgactttgcataaatagccaccatcgggtcattttttaagatttggtccagttgaccctcacagccttaaaaagcttcgtccccgagacgtcgaaaggccgtgtttgcaacacaaggtttttattgtaatttgaaaaaaaaaagagtcaacggtcaggtgaatgccgtttggatgtttagtaaaaaaaaatgaaaaataaaataagccgagccagattcggccgcgtcttaaaccgttcttgccgaaatagccttagagtatctttcagttgtcgaaaaactattttcgtaaaagaacggacaagtttgtaaagtgtcataaataatcctccccggcctcaaaattcacgtgaaatttggaaagggccacatttgcaaaaataaccgtttggttgcatttgtcgaacagagaaagggagctagccttttgtttttgagtttgtaaagcttttgattagaatatgtgggttgtttgattttcgagtttgtaggtcatattcaaacctttgaaacccagtttgttctaatatgaaaaatgtttattattgtttatcttttattgtccgaactacgcaaggtctgattcatgcggggacatgatacgtaggcaatctccataagattcgaccaccactaaaaaaaaataataataaaaagaataaataaataaaggaaagtgtgggaaattttcggaggggcacaattgtatctctgatatatgattgtctgtcaaatgccctaacactaacattgatggcttccctttgctgtgttcatatatagaaaaatggttggttgtggtagctcttccctgcaaagcaaaatcaaaggacaatggctcagaactgcagaaccgagtgggtcggtatcgatgaccgacaacaattggtcgaacggaataacgggttggtagaggaaatgaaaatgctgagacaacatgtggcagatatgtatcaggcatggataactggaaaagcaccaccccctccaccgccaagtctcttgaactcggtcatttcccaagcacccaacaccataatggaagatcccccatactctccatcccaacccacttatggcagccttcccagctacccgagtagctccatcactcctcaatgcttctccactccccaacaccacttctttccccgccatacttcactttccacgcacccggatccacaaaatgcctacccacctacacaagcctaccaaaagccgcctggatcaggtttccggccctgtcaacatgcaagaatgaaaaggttgctgaaacgaggaaaggctctcacccccatcggggtatcttatgccggtctgtttgaaaggctaaggcatgctggttcgattgagccactccccgcatgtactataaatccgcttgcaaggagctttgatccggcatcacgatgcgcctaccactccaatgtcatagggcacaacattgagagctgtcatagctggagaagggaagtagagaaaatgatccgagaagggcgggttgcgattaataacagtgacagggggcactcgaacctcctcgagaatttgccgacggaggttgatgaggttgaagctggtaatggtctcggcagtattgatgcaaacctcagtggctaaaatgccaattttgataaagtgggaggacgttttgttcctgggtcagcaagagagaagcttgtggtggctcattttgttgtcatttctgttgttcggattattagggttatgagtcggatgttgtcttgtccagtttgtttttaggattttgttctggattgttttgtttgttttgttatttaaaccatttcaccggtagtctaatacaaagtccgatcttttattatttccagtcatctttttgtttagtccttttatcatttttgattccatgccgattctagggacatgacatgcgcacacagtttgggcctagtctttaaagttaatcataaaaccacagaaaggcgatcaaaccatttaaagaaaataaggacggtttgagattattcagagctcgagtcatgtggaactggggcaagttaaacaaaaagaaaaccgtttaaaagcaagattcgccaaattggcatgaggttctttcataataatgagaaagagagtgtcacccaacggtttagaagtgacaaatgaacaaacagacgtttaacataattgtcaagtccagcaccatcagaagggactacaagtttaaattgtgttgtttgcgcttggcatgttttgaagactggaatgacgaaggcattttgttctgctacccaaacactttatccttcgttaccccttttgagccttatttattttctttcatacccctcgttcggaattagtagcaacgattggaatacgcaagcatggcagttaagagaaaagaaggaaaagaaaacaacaaaacgggaaaagaagaataaaagaaaaaagagagaaagaaaaaatgaacgacaaaaagaaaggagaaatgagaaaagaaaaaggcaaaagaaaaagaaaacaaagataagaatgagtgaaaagaaagtcacaagaaaaaagaggaattgggaactacgtttgacctgattcctcaaagaggatacgtaggcgcttcacggctcggtcatagttttgaaaaatgaaaaaaatcagttaggatatccccaagcaagaaactggggcaaaagttgcgtttgttgtaaataaatctaattccgaaggttgtaactaataacaccaaaaattaatgtatttttgagccttttataccctttgtttctagcctatccaaaacccacattacggtccaaagaaagaccttccgatcagtcttcaaaagatgccaagacagacaaatgaagagtcttaccggcgaacataacattctgttccacagcagaaaggactctaatctccagcagaaagagtcataccggcgacactccaaatccccagctggaaagtgatacaaatgagagagtcttatcggtaaaaaccttcacaggcaccataaggcgatgaaagctgagaaaaaagccaaaaatgagagagacttgatagtgaaaacccttcgggcactgcaagtcgaataagatcaagaatcagatggggaatcaccaattgaagatcttgaaagatgattgacggtaaaggataggccacatatacatgtcatggccattagagtcggtatctgcatttgatatatttttatttatagtttcttttgtaaaagagtcatcgtttcctttgtcttttattttgtttctgttatctttctcctttcataaaaaatttccccaatagagtctgtccggtcagaacaagtatgaaatgacttcaaaatatgccatcagctttccaagatgagatctgactagtatatccaaatggtatagtcagcgaggaacaagcgcgaggctagtgtcaaaaaagatatccccagcaaagggaattgacaaaaggattgacgagcgtcaagagagatatccttgccaaaaccaaggttataaacctcaaaggccaaggcccatgaacagagcaaggagagcagtgagcatgatttggcgaaatccatactagactaaaaggtcggggaaatgccagtttccaagctatgccacaaaagaagagggatatccccagcaggaagggattatccccggcacataatatcatccctaacaagtcgtggaacatagcgcaatgaaggagaaagggaaagtcatcccaataggagtatcacagccaaccaccatgttttaaactaacaaattttgtttgatttgaaacaggtaaatgaaatggcattgatgcagaaacgcatgccacaagggatattatcaaactggggcagaaaatttcccttccatttagaaaattttctggaagtcaggtaccctcagctgataacattttacccccaataggtaagtaaataattcctcaacagtattatccctagcagttgcgaggagtccaacacaaggttggaaagtcggtatcctcagcggttcctttcagggaaaggcaaaacgactctcaagggaggtagtcttcgaaggaagaagctatgaatataaaaataaaaaaaaaataaaaaaaataaaaaaataaaaaaaaataagaataaaaagataataatgaaaaaaagagggaaaattcatcccaatccccagcaagtattcgaggtaagacattttcaagtcttaaggatattttgggtccatccgccttcgaataggatatgtcgggttcatccgccctcaaataggatatgtcgggttcatccgccctcaaataggatatgtcgggttcatccgccctccaataggatatgttgggttcatccgccctcgaataggatatgttgggttcatccgccctcgaataggatatgttgggttcatccgcccgcgaataggattttattttctaaattgttgttgaagacaggcgtccacctgaataacgagaggaatacatttctgtcttttcatttctgttctaggtcacccaccagtataatgcgggcatatcatttttcatatctttaccaccaggcgcccacctgaataacgagaggaatacttttgtctgtgtatttcatattttaggcgcccaactgtataacaagggaatacattccacgtctttacccataggagatgcatttcctcctaagtttgttttagtttcattcataggagatgcatttcatcctaagtttattttagtttcatccataggagatgcatttcctcctaagtttgttttatttgcacgcataggagatgcatttcctcctaagtttagttttacccataggagatgcatttcctcctaagtttagttttacccataggagacgcatttcctcctaagtttacttttacccataggagaggcatttcctcctaagttgttgttgaaaccaggcgcccacctgtataacgagaggaatacatttcagtctttacttttcaagtgttgaagttgggagcccgcccagataacagaggcatacattcagtctttacttttcaagtgttgaagttgggagcccgcccagataacagaggcatacattcagtcttttactttcaagtgttgaagttgggagcccgcccataataacagaggaatacattcagtctttactttcaagtgttgaaattgggagcccgcccataataacagaggaatacattcaatctttacttttcaagtgttgaagttgggagcccgcccagataacagaggaatacattcagtcttttcatttcaggtgttgaaattgggagcccgcccataataacagaggaatacattccagtctttacttttcaagtgttgaagttgggagcccgcccagataacagaggcatacattcagtctttcatttcaagtgttgaagttgggagcccgcccataataacagaggaatacattcagtctttattttcaagcattgaagttgggagcccgcccataataacagaggcatacattcagtctttatgtttcaagcgctgaagttggcagcccgcccagataacagaggcatacatttcagtctttaattttcaagtgttgaagttgggagctcacccatacaacagaggcatacgtttcaagatcaagtccaaggacaataaaacagagggttacagcaggaatccccaacaggaaacaataaaaatcccagcaccgggaagcaaaaggttgtaacaagaggccccagcacatactcaagagcatgggtcaaaaggaagaaaagcatcggaagaaaagcaccgaaggaaacacaagcctacaagaaagcaaggcaacaagaacaagttacagtctagcctagcttcttgttttcttttaaacacggtgtaacaaggagatcggtaagcagtgataacagcaggaaacaacagtaacattgcagtcccacggtagtcccagctaccaaaacttcccgaactacattaacctgattcccctttagccagggatatgtaggaaacctttgaagcaaaggttcagttaaatctttttcaaaaaatgcttcacacggagtactcggatggacaaaaatcgctcgtttatctttgcgcgaaaacccttcgtgtcttcgggcaaagaggggcagctgtaagcacgtgatttttgccctatatgagaaatactcccaaaaaatgcaaaataaaatgattttccttggtgtgcaattttgagtatttttgtgacatttttggattattatttgtatttgtctgtgtttgtttatttgctaaattaataaaaaatacaaaaatatgtcgcatttgcatgtaggatttaattctataatttttagtaattaaattagttttacaaaaattaaaaaattacaaaaaaatatgcatcttttgcatttttagcatttaatgtccaaatgaacaattttatgcttaattattacttaattgtgcgttaattgttagtggtagtaaatttgcgcttttataacttaatttagttcttaataataatttaagtatttttataatttagttttagaaaataaaagaagaaaagataacaaaaatacaaataaaaatcggattgggccacttcttcaattttcaaccccaggcccaaacaatcttctccatgacccagtccacttcagaccgggtcgacccagtccgccccatgacccaaatacccaacacccctttttcattttgtcaaaacacaaaacaaaacaaaaaataaaaaacccaaaaaccctaaaacctaaactaacccatccgccccttcgctatcttcttcttccccaaactcaaaaaaaactcctccaaagctccaaccaagcatccatggctgcccagcttcccgtcccaaacaccaccaaatgacacaacctccttcgcattcaaacgaccccagccctatccgccattgatgaagctcgtcgagctcaagcttgagctcgacgtccatgtcgctgctgcttctgtttcaaaccaaacaacctgctactcctgccttctacttcatcgtccaaacaaccaaacgaccacagcctcgacgagtcagctgttgttcgaagctcccatcgccgctgctcgtcacggccaagctcgcacgctgccatcgggtccaataccgtttcgccatggacgtcgtcagttgcttctgcttgctgcgtcgaccagctttacggcttcatcttcaccatggccaaacgacctccgttactgcttcgcttctccgagcttgggcatcaccatggccaggttgtcgccggactgctgctgctcaataatattcaagttctgctgctgcttcgcttctccgagctgctgctattcatcacttctccttcgcccagctgttgtatcttcagacgagctgctcgtttgagttttagtcgagatcgtcgagcgtcgttttgagttcgtcaagtttacaagggaggtgagttcgtcgttgagtccggacagatttattcccatttgagttttgtcaaaacagttcatacatatgtcgtgttgatccggttagtagtttttgaattttatgtttgtccgtattttgttttgatattttcgaatctaaaatcggcaaatgtttgttttgtttatcgtttgaattaatgttttgttcatgttcatgtgttgtttgttaaattaatttttcagatttcaaatgaatgattaattagttatttttcatgtttatttcatgtttgtattgttgtttaagtgaatatttgttagttttatgtttgttagattcaaattgaaatttaattaattatttcttcaatttgtttcatgttgttatggattttccagaaaatattaatgttgtttgaatcgttagaatccgtcatgtgtgttgcttaaaaacagatttaattcatgttcatctttgtttgaagttcatgtttaaatccagcgatttaatgtgagtttatgtttgttttgatttgttagtttaatttgaatcatgcatattgttgtttgtattattgtctctttgttcatccattaatgatctaaattaaccaggattggttcccgatatggttgatttatttccattaatttggaattttgtgttgttcatcatgttcatgtaaattgttgttgaagattgttgagaaattggtcatcttgactatattttggtcaagttatgattaattgattgtttagagaagaggggtaatttggtaaattgcattgcattcgggggtagatttgtaattgcaataaggtcggaggggtagtttgttaattgaacattattttgattctttatgttaagcatgggggacaaatataatggggtggggtttttgaggtatttgtttaatataatggggtggggtttttgaggtatttgtttaatataatgggggacaagacaaaacataatgaggaggaatcttgtactttttttaatataggcatgggggacaaattataatggggaggaatcttgtacttttttaatataggcatgagggacaaattgtaatgggttgggaatgtgttagttatttaatgtaggcatgggggacaaaatttaaaataaagaagacatttaatagtgggccaaagcatgccattgggggaataattttggggttgggaatggaagacttgtcttgctatatatagaggactattcttgacattaaaagggaggagaacttgaaccttgagaggatttttttggagagaaaaaagaagagagtttttagaacttgaatattaagagatacctgagagagtttgtgagagtaaaagagaaatccaatttgaactttcactcgaataatttctgtttgcttttcttcgagtgttattcaaaaatccgaagctactgcatctcgtgtcttttctctcttctgctttgactgtgattgtacttttttcactgttgagttttcaatctgtcactgggttattctactggttgttactggttttgcggtgttgcggaacctgctgttgctgcgttattactgttgctgactcctacttctttgttcttgtactgctgtttccaggtacacatttgtacactcttagcttgaagcgaaaaatgaaatattaatcaggctccggttcctgttgaattcttttgtttggatctgtgtttgaatattaattttcctctcttcgtataaaaatgtagtcgattaattaatgagtaatgaggttgcatatgtatgatttcttcatctaataatgctagtttaaattatttgaagaatagttaatcggctttgatattattgtgtatttatctcatgttctagcaaataataaaatgtggaatgaaagcagtttttccttgtacaaacgcgatcgcaattttccgttcacataagccgtaacttaataactaataagttgcgtttttcagcatgtaaataattaggagatttttcttttattttagagacgaacttaatagaaaatgtagtcgctataggtttatccttttaaaataaaaatgagacgagcctcgccaaataaatcataaaccgccggggccctcaataaaatacataaccattgactagactttggatttggccgtttaatgaaccttcacggcctcttcctaaaataacaatacgttagactctttaggatgcgccttaataaattttaccttcttaaactcgggtgcacatttatgtgacccaaatccaattctcaacggagtcgaaatatttctaatcacgggtacattgattgtgacgtggttcgagatgcgtgtccatgacgctgcaatttcatttaaaaaaaataagaatgagatgagcctcgccaaataaaatacaaattgcggggccctcagtaaatatttgctttaaaaattgtttagacttcgggatggaccgtttggtaaaattccacggtcctacccaaaataaatacgctagtcgctttaggcgcgcctttaataatttaatttccttaaacttgggtgcacattgatgtgacccaaatccaaatctcaacggattcaaagtgtgtcgacgaccacgggtacattgattgtaacgcggttcgagatacattttcacaacgttgcaattcttgataaaaacagtaaaatggtaaaagcggttaaaaattaaattttgcacataagttcacacttgtataaaatcagataatcaagcacttgtagatgaagactgtatgaagcctcgagcacttgtttatttctttcaatttggtccttttcctaaaatagaaaaatatacgggactcggaggtgctattatagatgaagactgcctaactcgtatgtatttccatcagattaattgtaaccctaggctgggaattttagaaaactccattttgccttgcaggtcatgactcatcattcggcacgagttagggtttttgcctagcatctaaaatcgttagtaaaactttaataattcaaaagaaaaattttaacatggcgatacctgaccgtgggtactttatcagaagtaatatctctttaaatggacggcattccaatgtgagggtaaaactttgccgtccattgtctccaactcgtatgctccttttcccgcaatgtcacgaactctgtatggtccttcccacattggacttagctttcctgaattagcagcctttgcaaattggaacaccttttaaagcacgaagtccccaattttgaaaaatctgaggcatgctttcctattgtaatatcgttcaattacttgcttttgtgctgccattcttatcaatgcagcttctcttattccttcaagcaaatcaaggttgacccgcatctcttcatcattagattcctccgttgcctgaacgtaccgtgtgctcggttcacctatttcaacttgaattaaggcttccgcaccataaaccattgaaaatggtgtttctgcagtgcttgtttttgtcgttgtacgataagcccataatactccaggtaatatctcaggccaattaccttttgaatcctgcaacgtcttcttcaagttgttgataatgactttgtttgtggattccgcttgtccattacccactggatggtatggcgtagatgttatccttttaatctgccaactttgaagaaattctgtgatttgagctcctatgaattgtggtccattgtcacacacgatctcctttggtgctccaaagcagcatattatatttcgccatatgaagtctttaacttccttctctcgtacctatttaaatgctcccgcttctacccatttagtgaaataatctgtgagtacaagtagaaactttacctgaccctttgtttgtggtagtggacctaggatatccattccccatttcataaagggccacggggctataacagggtgtagtaactcagctggtctgtgcatattattgccgtatctttgaaatttatcacatttggacacgaaattatttgtctctttttccatattaggccaataatatcctgctcgaatcaatgttcttaccagtgaccttccccctgcgtgatttctacaatgtccttcgtgcacttccctcatcacatattctgtttgagagggtccgagacaccttgctagtggtccaccgaacatctttcgataaagatttccttgatataaacaatatcgagcggcttttttgcgaagcgtgtgagccttccctttgtcattaggcacggttccgtgctgtaacaaaataataatttcgtttcttcaatcccatgttaaatgattaaaatttacctcattcttatcaggttcgagaacggaatgaaataaatgtatgactgaagcatttgcgtcatttgctatgtcagctgcagatgcgagattagctaaagcatctgcttccacattctcatctcttgggatctgcattaccttccaagtttggaattgctttattagttcccgtaccttttcgagatattcttgcattcgagtttccctggctgtataagtccccagcatttgattgaccaagagttgagaatcactcttgattataatttgtgttatgccgagttctcttgccaattctaaacctgcaattacagcctcgtactctgcttcattgttagttatagaatgacattctatagcttgcctaatagtttcacccgtaggtggtatgagaactatacccagacctgctccttttacattagatgaaccatcagtgaataaaatccaagtccccgggtttgcaccattaaaaacttgtaattctttttctgcttctaaatgcatcctctggctaaaatcagctacgaaatcgactaatacttgagattttatagcagtcctaggttgataaatgatttcgtattcacttaattctatagcccattttgctaacctccatgacaattcatgtttatgaaaaatgtttcgaagcggaaaaatagtaactacaacaatgggatgacattgaaaataaggtcttaattttctagatgccatgatcaaagctaatgctaacttttctagctgtgggtatcgtgtttcagtatctagttaggacttacttacataataaataggagattttttaccttggtcctcacggactaaaacagcacttaccgcaacttcagacacagccagatagatgagaagcttttctcccacctttggttttgccaataacggtggttttgacaaataagctttcaaatttctaagggcttgttgacaatcttcattccattcaaaatgatcttgctttttgagtgcagagaaaaacttaaaacacttttttgaagatttggaaataaatctccccaaagctgcaattcttccctttaatctttgaacttcctttttattagtaaggatatcagggatttcttttattgctttgatctgagaaggatttacctcaataccacggttagaaacaagaaaacccaaaaacttacctgacgcaactccaaatgcacatttttctaggttaagtttcatattaaattttcgcaaaatttcaaatgtaacagatagatgagaaatatgatcatgagactgctgggttttgacgagcatatcgtctatatatacctccattgtctttcctaaatgttcttggaacattttggtgaccaacctttgataggttgccccagcattttttagaccaaagggcattactttataacagtaagcccccctgtctgtgatgaaagaagttttttcttcatcactagggcccattttaatttggttgtaccctgaatatgcatctaaaaaacttaaaagttcatgtcctgcagttgcatcaattaattgatctatatgtggtaaaggaaaagaatcttttggacaagctttattaagatctgtataatctacacagactcgccacttaccatttttcttaagtacaacaactgtgttggctaaccaattagggtactttacctcgcggattgacccaatttttaatagcttttggacctcatcttgaatcacctggtttttgaaatccccttgctttcttttcttttgctttattagtgtaaaggatgggtcttcgtctaatttgtgagtcatcacatccggtggtatccctgtcatgtcagcatgggaccaagcaaaacagaccacgttagattttagaaatttaattaacatacctggcatgtttgagtttaaattagctccaacataaactttccgttcaggccattgctcaaataatatcacagcctcgagttcttcgatggttgttttgatattttcattctcctcaggttcttgaattgtatcaggtctcgagtctaaatctgttttctctcgctcagttgaggtttgattgctgacaccttcaactgtttcctgtaattgctatttttctttgtttacggtgctcgtatctgttatagtgttgatactcctcgttgtttgctgatctcctcgaatttgacaaatcccccacggtgatggaaatttaataacttgatgtagagttgacggaacaacatccatatcatggatccaaggcctccccatgatcatattgtaggccatttccatatcaactacctgaaatttagtttctttaacaacacctgcagcaaaagttgttagaattacctctccttttgttaccacacttgaattatcgaagcctgacaaagtatgcgccttgggtatcattttgtcttcaccttgcatttcacgtaatacccttagtaatataatatttacggaactccctggatcaatcaaaactcgttttacattagtatcatgtacaagtaaagatattaccagtgcgtcattatgtggagttatcactccttcggtatctgcatcatcgaatgaaatactttcattttctaaaacctgccgtacccgtttcccgtgtgtaattgttactttagaaaccttgttggaagctgtgtaggttatgccgtgaatatcttctcccccacttatcacattcactgttctcttgggtgaaggagactttggtggatcttgcctatttttcatataggcttgtttacctttttcactaaataactcagtgaggtacccttgcttcaatagatgatccacttcactctgcaagaatctacattctgaagttttgtgcccgtgatcattgtggaattcgcaccaatgatctggattgcgtctatttggatttgaccgcatctcttttggccatcgtaccttatctctcatgcttctcaaaacagccacgagctcggaggtagtgacattaaagttatatccgccgaaccttgcctttaaacttctgtcatcatctcgtgactcttgtctgttccgatcatttctgaatcttgatgaagaaccagattccctgttcctcgattttttatcatattgctggctatcttgttttgaccgtgattcttttcctgcaggtcccatatatggatcgtacctgtttttacctaatcttttttcggtttctgatcttctggaaccgcccctttcttcatgatgaaacttaggtacggtatcttcttcaattcgcagcttcgtactgtacctattgtaaacatcattccacgtggttgcagggaattctcgaaggctttctttgagtcttctcgtggcttcagaacttttgtcatttaaattacttgcaaaagctattgaaacccagttgtcaggtacacggggtagagtcattctttcacgctggaatctatcaacaaagtctttgagcaactctgaatccccttgtttgattttgaaaatatcttccattcttttctcaaccttttgagctcccgagtgcgttttaataaaagaatctgcaagctcagcaaaagaatttgtagaatttttagataaaagagaataccaggttaatgcacccttggtaagtgtttctccaaatttcttgaccagtactgattcaatttcttgttcggtcaagtcgttgcttttcacgcctattgtaaatgcagtcacgtagtcacgtgggtatgtagtaccatcatatttcgagatgtcaggcattttgaacttttttggaattggaaggggagcagcacttggcttccaaggttgttgtgagtatttgtccatgtatactccttttattacaggcgaaactccagggatttgctcaatacgctcattttgttccttaatctgtttctgcaaggttagtactaaattttgcaagtaggaattatttgaattacctggccccccttcctgtggttcactagtggttcctccatttccagaattaacaagaccagaacgaggattctccaatgtattattattaggagttggtgtgggtggtgcagcaggcaatcgactaactagagcctaaagagctttgccgacctgtgcatcaattagcttttgtaaagcttcatttgcacctccttcaaaatgtttagattgttcttgttggtcagcacgggattcaggagcaggagtgccttcacgagattgacgtggtgaatctggaggggaggtaaccacgtcaatgttcggtaggtctccttgattttcatggatttgattttcatggtttcccaatgtgttatcattgttattgttgttgtttgacatgttgataaagacgaataaaacatagcttcaaagaaaagattatcagttttccggtaacggaaccaatttgtttaacaaaaaatgtgattctttggtcaaagctaaagacaaatagaaattcgggctactgataatcaggagacgaaaaagaaataatagactttttgagaatgacaaataaacagtaaataggtttgtattctaatgtaatgtttttgatctcctcccccctacaaatgacgagacctcctccttttatagttgattctaagtaaaggagtaataccttagtcttaatgagacaattatgagcaataaataatattaaataagacgttacacaatcattcctatttaataccaattctctaacgtattgggtatttaatattgaatttgggctccttttcgtcatcatatccacgtcttcaatgccttctgatctcttggctttaaatgacctaaataggtacgaagcttgtattattcgaattgtctctcgtgcctatttagctttcctttccccgtatttgttgtcactcgtgcctcttaactgatcatcatgttttgaccatttgaacagttctcatgtcatgtcacgtcaccttcaatgtaaattcagttttttcccaatacaattgtcatttggcgtcagcaaggaaaaatttcgaagccagattgtaaagtatattccgtcgtccttttcgttcgttgctcgatggtaatttgagacatttcaagttttatagtactgaccttttatcattcttcctttcatcaatgttttgacatgttgctttcattagtttaatattctgcttttcttatattcgtcatcaatattaaaagtaattaagatcttcccaaaaaagtttaagagaagtagaattaaggatctaaatccaacatgcatcatctttcagttgctaacacttttgtccccaccaaattaaagcagattatacttatcccatgtaactcaatatatgcaccgtccgccccctaattcctctctatcaattagtccttaattttcctaagaacattctcaccgcaaccacctcctcttttgccttgggatatatagttccgttagcaactataaatttagccacaatgtgagtatattattcctcaacacaaatatattatagcacaaattaaccgcaaatttgcaacatatatataatgcactgcccaaatcaactacttttaaccaaccacatgcattttggacttgcactgcctaatactaattggcagtgcaactctaaaattagttatgctccgagcagtcgtctaaatttgagtattgctcggagtatcaagatcagtaactctggccataactacctcgttgttgatgataaagtcaaactcggagagaggtggatggaatttcaaggaatcaaaaattgggatggtttgcttgatccactagacgatgatcttcgcgaggagattttaagatacggagaatttgtcgaagcagcctattgctgcttcgactttgacatgttgtcagccacgtatgcaacttgtcggtatccaacgtgtacgatgctgacacactgcggactaggtcagagcgggtacaaggtaataaaaaacttgcatgccacgtgtgctgttcaaatgccacggtggactgagagatttcctaatttggtgtcgccgcggtccagctggattggttacgtggcagtatgcgatgacgtggacgagattgcccggctaggtcgcagagacgtggtgattgcttttagaggtactgccacttgttcagaatggcttgaaaatttacgtgccacgttaacttgcttgcctgatgacatggcacctgaaaatagtgaacccatggtacagagtggactcttgagcctgtacacttcgaaaaatgaagggaatccaagtttacaagatacaataagagaagaaattggcagcattctcaatacttatagtaatgagtctctgagtataacagtcacaggacatagtcttggagctgccttagctacacttactgcatacgatataacaacaaaatttagtgatttgcctatggtgacagtagtatcatttggagggcctagggttggtaacaagagctttaggtgccaattggaaaaaaatggaataaaggttctcagaattgtcaactctgatgatcccataacaaaagttccgggattcgtgattgatgacgtggaaagccaaggagcagccacgctggcaagattgacaagctggcttggaaagtacatggaagatactcaatgggtgtatgctgaggtggggaaggagcttaagttaagtagcaaaggaaataatgtagcaaaatgtcacgatttgaagacatatttgcacttggtgaacaattttgttagctcatcgtgtcccctcggggccacagctaagaaagtagtatcaaagagaaaacaacgtgaaagaaaagcagttgtagtttaatttgatggattttctataattaatacgtagaataagcataagaataagaatattgttacgaaataaaagcaatttagtaaaacatgaacaagaaataaaagcaatttagtaaaacatgaacaagaatagagatagagagaaggaagagattttcttctctaattgtgtgtattttcctatctattacaaagcttttatataggcatgaaaagtgaagaaaatatgtcatggaatatgtcattgaacatagaaaatatgtcattaaccatttgagagaaagatcatggaggaagagtagacatccaccatattttgatttttatcataacactcccccttggatgtccataaataatgtgcctcgttaaaaccttattaggaaaaaaccctatgggaaaaaaatcctaatgaaggaaaaagagtacacatatttagaaatacgccttttggttgcctcgttaaaaaccttgcaaggaaaacccaatgagacaaaaccttgtaagggaaaaagagtacaacgcgtattaaccccactgatgagatcatcagttcacatcgttgagccttcgtatcccaatcttgtacactagtttcttgaaggttgatgccggtagatatttggtgaaaaaatcagccatattatcacttgaacgaatccgttgcacattaatatcaccattcttttgaagatcatgtgtgaataataatttaggtcaaatgtgctttgtcctaactcctttattaatcctccctctaattgggctatgcatgttgtattttcttcatacaaaactgtgggtagtttatcacacttcaaaccacatttgtctcgaataagatgtatagtagacctcaactatacacattctcgacttgcttcatgaataacaattatctcagcatgattagaagaagtagccacgattgattgcttagtcggtcgccaagatatgacaatgccacacatgtaaacacataacatgtttgagatcaagccttgtgtgtgtcagataaataccccacatcgacataaccaacaagatcggtattgcaatcattgccataaaataagctcacaccggtaatcccccttagataacgcaatatgtgtttgatttcattcaaatttctccttgagcggagctatatcttgctaagacattaactgaaaaagttatatcatgccttgtagtgttagcaagatatattagcgcaccaattgcattaagatatggtactttaggaccaagaagctcttcattattttcataaggtcggagtggatctttatttatatcgagtaatctcacaactatcggggtacttaatggatgtgctttatccacatagaagctctttaaaatctttttagtgtatgctgattgaaggacaaaaattccatctttcatatattcaatttgtagaccaagacaaaattttgtctttctaagattttcatttcaaattctttctttaaacagtctgctgctttaggaagctcttcgagagttctaatgatatttgaatcatcaacatacatggcgattataacaaattcaaattcatatccttttataaggatacaaggacaaattgaattattcttatacccttcatttcaacaagtactctctcgggcgattataccacatgcgccctgattgtttcaatccgtataagaatttttgaagctttatttaataaatttcttggaaaccttaatatgctccaagacaatttaaatctttcaatgatatctactataagagaacatggcttcatatattcaatgtgaggatatttactaattttcttgtgccacaagtcgtctttatgtctatcgacttgaacctttcgaacaagaacacatttatacctcaattgactttatactttcaggttttggactatccgtccaacttcacatttttcaagtgaagtcaatttcattgcgtatttttatttggccaatcttttatccgtccaaatttcatgacagatttgatctcaagatcctcgtcaatattaatcatattgagcgctacattatattaacaatatcgccgacaatcattttatgtcggttccattattacccaataaagacataacttattgagatctctttatttcattattttcaggtacctgagcctctcccatgaggtcttatgaagtgttatgtcgtggtgctcttctagggcacttgcctccttattatgaccattttgaatatttgcccctctccttcttcaaggagttttatctttggaaccgattggtctgttacacttcatgtgtgccatagactctgtccctcatggactttattctatttggagcattagcagctgaaatatgacatttagttttgggtcagcaaatgcgtctggcaataatttgtaaatgaatatcacttgaacttcaagtttatattttcttgtacgaggatctatatgtattcataataattcatttcacgtatcactttctcagctgcccattttctccccctaatgttgggatcaccaacacatttcccaaccatctttgggaactcatgtttgtgcattttggtggcataattaaatcatatagcacattcatatttctatatagaaattatttggttcctgaccctgaaccgattgtgatagggagaaattttcataacttggctagatgcgtacaagtgctgttgtatattaaataatacatctcataccaaaattcattttttttggagttttgttctcataaccaatgatttagctataattggaggcatacaatttctgctaaaccaacttggatttaaaccagtattatcaagataaatcatcataatttatattctggaactgtgctctaataatttgagcaagcaatgttgcaaaagccaaactgcaagttgataacaaatgcacatgtgaccatagaatagatgcatctattaaaaatcatatattagtaaacggtccacatggcaggtgactgggcccatatatttatcaccttttattcgttccagaaatcaagagattcaaactcaaccttaactggtatatcatgagaataagcaacacaagagaattcttgaagaattttctattcttcaatatatgtcaatataattcttaattaatttttttgcatcataattgaatcaggatggtcaaccggttatgccaactaatatttgttttagtaaacctctagtttacttgtgtcatatgatttcatcatcatgcttatatttgtgtagtacaaataggaagaaaatcgggtaaccttttatatttatccggtatgattatagaaatatgaagatattcaatcttcctttcatttatagtctcaatttgacaaccactttgacttatacatttgaaactcaaaaagtttcttttgagactttacaatatcaatgtcatgaataattttattcatctgggtagtaacaaatcagtttttccggagctcttaacaacttttgtactacaagatcttttatcataccattcatatggtaaatgtctccttcacggagaaacttatatcataataaattgtcatggtcaaaattatcataagcaaaattatttcttgctttaattttgcctttaataatttttataagcatgccaaaatattttggcgtatcacatgtacgagaccaatgacatattcatgtaaccacataataatatttgttctctttatttcactcaaacctccctcaaaggtgagttgtgtggtactcatccaatcatgtcttgcatgtctttattcattacttttatcacatattaccacattcacctttaggaatgggtctgcatcctcaatgcttatcacaagtcacattctcttcaaggaatggatcataatcaacgatgtgcttcataccaatttgatgataaacattgccttcacattttgaaggactattttgagaacccttgttgttctccttttttaatcattgtgatgattattattattatttggaacgctctcgttcattgttcaaccacttgtcttcatttagacttattatgcactgctatcatatttacttcaaaaatgtagcaaatcaagtgggacaattttcatgccttttcatggaaaatatattatttttctttagtcatcattatatcataaatatggtacattgggactcaaacccaatatcttaccaatataaaggcatgttaggccataataaattgggactcaaactcaactcttatcattatggagcatcaggacttgatcccgatgtcttaccctcaatcaatggcatagtaggctaaaaaatattgagattcattctcaagacttaatttcaatcacatgccaagaaagttatacacaactaatttgcatcttagcaaatcaaatttgctttgttaaataagtgtacaaatctcaaatcagcgtaaatctttattaatcatttgtagcatctatatgaaatacaaccgtttgtagtcagaatatttcttctaaattctattagagtttaaaaggatcataaaatcattgtcataatatttattgagtctctctcaaaaatattgttgttttcggggtataccctacctattggatttgattaaacgccatgactttccttcactcaattcaaccaagcaattagtgaataaatttatcaaaagtacaccatataggtaacaacacacatatatagtactaatacataaattcagcatttatattacctgaaaagtgacattataggtcacaacttaccagttgtagcttgtgcatcattcatataaaatacttaaaaatggtaagtcagtagcaagcatcaagtaggtcatggatactcaaaaatacctcttctagtagtcatactaatcattgtttgctttcaaatgatacgaccataaattatgaagtatactttctcaatagctggtttgttttttaaatttcaaagaagtaattaatcaacctagataaagatgtgaagtatttcttgttttcttcaagatgatttatgcttttaatcagtgggaccaattttattattatattttattccttttttttttggtactacatgcaagtgtaaaaatccaaaaggaaaaaaaaatattcatccaagtaaaagaaaatattaaaagcggcgagacagattgaagataattaacgcacaaatatgcataagacaatttatataaaatatctttggttaccatggcatgcatcatatcaacaattaactgctactatgattttcacatatagaacttcgaaaattttattccattcatgtgatataaaagatgtaatattaatatgtgcttatgcaatacaagtgtagtacgaagttgtgtgcatatgagattttaaaggaatgatacgtataagataatcataccttcttacatttcattacttaccatatgtagtttctctttatatttaaccgtgtgataatatgtatagcttctaattgtaattttttcggatgtaggaaatttttttgtagatatatatacaattggttagagactcgtgctgataacgtgttacgaaataaaagcaatttagtaaaacatgaacaagaaataaaagcaatttagtaaaacatgaacaagaatagagatagagagaaggaagagattttcttctctaattgtgtgtattttcctatctattacaaagcctttatataggcatgaaaagtgaagaaaatatgtcatggaatatgtcattgaacatagaaaatatgtcattgaatatgtcattaaccatttgagagaaagatcatggaggaagagtagacatccaccatattttgatttttatcataacaaatacaattatttttttttaccattttttggggtccgccatattcccttcggtgaccatcctgagagacggcttttccattgccctctttgtatatcctcgatgaagaacaagtacggtattttattgtgtatatatacctgcttctgctttggtattgctactattttgctggtgttgttgtttttccccggggcggatctacacatacactaattttgggtgctcgaacacccattaacctcggctcctagtagatgtagtcctatacaaaatttgaggaaattaatataaaagagcagaaagcaccagaaagacaaaaagtctaatgggtgctttgattaagggagggggttggaagtttataaaggttgaaggggcgagggggttcgaaaccgtttctcaacatgccttttaaaacaggcaatatatttctttttatttttccctcatattatcaaagctattttctactagttttcaccagccactttttctacacattactaccttttaagagtcatttttgctaactttggtttatctcttattattttacaaaattcaattcactataaagaaagaaaaaggacttcaaagttcgacacttgtgaagacgagcaattcatctgaagggacaaacccatcaatatctcttctcatcaactgcattatccatcacagtcttacggcgtccataatattaatactatgattttctggattttgatgcttaccttcttataattaaaaggagttctcgttaacttttttcaccatcgtgttcaaatagttatgtatttatacaatgtgattggtaataactttacgctagaaaaatctaagcacccacgaacttaaattcctagatctgccactggctttttcatgacttttttcattaatatatctaataatgttagtacccgcgtgatgtgcagataatttgaaagaatattaatattataaagttattgtataatttatcatattattttaataaatattagttattattttattatttattgtagtgcacagaaatatagtaaaatatatacaaatcaaaggatacgcatcatatagtaattaaaaatttcatttaccaagaatatatttacagccgctcgttctttttggactataagaacaaggcctcctatttcatattctacctattacatagacagaactaaactctatatctatccgctatggccagcaaggaaaactatctaaactatttagtatctttcttcatctactttgtcgttgtcctctaatgtgtagttggagtacaatctccctgatgatatgcttggtgtgatgttgcttctgttgaaattttcgagcattgtgctccctccaaatgtgataaaattgtttcagcaaagagccagcccaatacttctactcgcactctattgttgttcactcttctgattatccacttaacttcctccgtctatgttcccacttgtctgtgttctcccatccatttcaatagtacattccaaatagtagcagagaatgtacaggcaaagaagaggtgagctaagttttcctctgcaccagagttatatagtacacattctctgctacttccatcacctttttgatactgcagggtgagagataggtatgccttcttaatattaaacttccctccttggacaaaattctgcaattcaaccggttgttttgagccctagcatatagtttggcagtttaaggccatgagtagcttcacttcaggtattatgacttgtacgcatggtcggaattgaatttcgggaagctcggagttgatttggaaatgaaattctcattttgaaagctttaagttgaaagaattggctaagatcggattttgaataaacgacctcagaatcggaatttgaaggtttcaacagattcgtatgatgattttggacttaggcgtatgtccagatcgaattttggatgacccgagagcgtttcggcgcctattgtggaagttagccttttggaaaaaatttataagtttggattgaagtgcatttcactattattgatgtccagttgggatcccgagtctgagaataactctgtatggtgattccggtattaggagcgcgatcagaagtaaattcggaggtatgtaagtcattttggagtcatttgtcttaagttagaaatttgaaggttttgagaagtttgaccggaagtggactttttgatattggggtggattccgattcaagaagttggagtaggtccgcaatattgaatatgacttgtgtgcaaaatttgaggtcaatcggaagtgatttgatagatttcggcatcgaatgaaaaagttcaaaattctaaagttcagaaagctcgaattggagtgtggttcatgattttggcattgtttgatgtgatttgaaggctcgactaggttcgtaatgtgttttggaattgactggtgtaattggacagggtcccggagggcctcgggtggatttcgggtggttaacagatcggattggggttgggagaaagagatgaagcctactgtcatctggtgtaaccgcacctgcgaggtcttagccgtaggtgcggagccgcagaagcggccaaaggagccgcagatgcggttgagaagagaaatgttgggactgcagatgcagtcatcttgccatagaagcgggatcgcacctgcggaaggggaagcgcagaaacggagtgacgggcctggtgaaagatagtagaagttgtagtggggtcgtacctgcggaaccgcagaagcggtcaagtgaccataggtgcgagaatcgggttgggtagtgtgttcttttaaaagcgagggtttggctcattttcaccatatttcctcgatgggacgattttggagtaacttgggagtgtcattttcaccaccaagcatgaggtaagtgatttatgctagttttgagttaaatacatgattatatacggatttagacatgaaaattagtagaaatttgaaattttgaggaagacttagaaatttggtattcttggattttggccacgatttcgggcataaaattgagagtaaattatatatttgagtttgtgaggttgtgggtaaactttatcttcaaaaaattttggaatccgggcacgtgggcccaaggataattttatcaaatttttgatcggggttaagaattgttatatattggattataatgagtgtttgagcatatattaatgggtttgcataattattggctagttttggagcgttgtgcatcgatttgggtcatcggaaggacttggaagccggttatggaactttagagcgaggtaagtctcttttctaaccttgtaagagggaattgtccccataggtgaaataattaaatatgtgctcctatttgtggggggctgcgtacacacgaggtggcgagaatccgtgcgtagctactattgtgcttaagcccgggtagtctaggacccaaaagcatgctttactggtaatatttgcaatcttgttgtcaatttaaaatgcttaaaacataccgaacgtgtaataaatttctaaaaggctagacatcattttcttgacttttgaaagaaaaattgccctttcttggataattgctccttaataaattcttgattgactgtttgaatgtgtttatctattgtggaacaggtcgaacacctcggtagattaaatggatgcatttatagttcacgccattcgaccctctggcaatgcacattttattattatattggatcgggccatacgaccttggcatgatttgtgcatgtttgtattgcttgacttgcaaatttataaatgatgatattgattctctggcttgagataaatgtataaataatgaaaataaatttggagattccctattaataaaagaattatttatttgcttcatgctattgagttacaaccgtttatatgaaaaccctcgatttactattttatcggtatattattattggaccactagtaagtgtcaaagtcgacctttcgtccctacttcttcgagattagacaggatacttactgggtatgcgttatttgcgtactcatactacacttgttgtgcatttttgttgcacagacacatgtacctctagtggcccagtgggcgtagcaacatgattgatatggagacttaggtgagctgcatatctcaagacgactcgtagccagcagagtctctttcagagtattatatttgctttctgtccaaacttgtattccggacaattattgtacttcatttgatttcctaatgattgttcatgcacttgtgacactgggttctcgggtaattatcggatattcagtattaaaaattgtaagcacttttatttattatgtgaagattgcttttttactagttaaattataggaaatttatggtttcaaagatattaaaatgagagtttaattaattatttaatgttggcttgcctgaccgaggtatccgacgccatcacgacctttaatggattttagatcgtgacatagagggtcaccacctatcaaccactgtctagcatcaattatctttcttacaatccatcaagctttttgtggagtcttcattctacccacttctttgccttttatgcagaagctgtggatccacttgacctagagagtgtctttttttaggctactgcccaaagcaatttacatatggctaccctattcctatgaagaaataaattatgtttagaaccccggcagattttttgcatacacagtttttcccaagccactaatgctcttttagatgcttgagcattcccagtctataagaaagttctacaaacactagtaaacagttgtagaactttttttggcagtaggaatacctgagcccggcaagtttgcatttttaatagaatactcttaatcaattacactttgccacttatgataggaattttgttgtccaacacctgattttggtagtcattctctctaccagtggaatacattgttgtatgttgaccttccaagaggataaaggtgccctaaggtatttgaatgggatctcccctaatgagaattgtgtctcggacaaaatctgctccttcagtgcttgagagactccaattatatacaaggaactcttttcttgattggctttaagtcctgtggcatcagaaaagtgattgaatgcttgaagcaccaatcttatagaagtttcatctggcctgcagtacattaacaaatcatccacaaaagaaatgtgcactaactttagcttaccacatctagggtggtaattaaagtcagggttgtgcctcaattgcttcaatgatctgtttagatatttaattgccaacacaaataagtaaggggacactagttctccttgtcttagtccattctttgcctttaacgtaggattaagaaccccattgattagaatagaatagttcactctgaaacacatttcatgattaagttaacaaatatttctggaaaaccgaactccaccagaattgcttttaaaatttctcattcaatagaatcatatgctttccttatatccactttcaccagacatcttggatataaacctttctgggaatatcctttgacaagctcatgtgctactatgacattatctaagataatcctccctactatgaaagcaaattctgatgatccaaccaagtagtccacaaccagtttgagtctatccgtaagtacttttgctattatcttgtagagagttatacaccaatcaattgatcggaattccttcacaaatgtaggattgagtatttttggtaccaatgtgatcgtagtactattggttctttgagtagcctaccagtttcaaaaaattgcactcttgcctatgttaaatcattcccaacaatgctgaaatattctttgaagaattcagcagtaaaatgacgagtttgaaacacacacttaaatatgttctctagtcgaatatagtaaattataatattgtatccacatgaattggagttaaatagttattatcgtagtttgtagctagattgctattcaagatgatcaacaattgagaattatgtgatttaaaactaatattaactaagagtcaaactattgactcatgacaaacaacgcaagtagtaggcaaaggaagatattaattgggagaaaatatggttgataagataggtgcaagataaatgtttgggatttaactctagataatttacttctaatgttcaagtgaatctctcgaattcacttggttattagttcaattatttagtagaagctcctctctcgattaagtctcaacctcacaagataaaccaattttaagcatgtgaagatatacaagaattcgtagtggattggtctttaggagaacctctctcgattattctcctaactaggttcaatcaacaatttaactagcctttttcgattactaagaagaattaaaaacttcaaccaacaaaatataaagcaacaatattacaagttgtgcctctcttgattacatgaactagtgaatatagaagcaacgattaaaacatccaaaatgattcaatacataaactagagttaattatccacaaacaagtatcaatacactaaatccatcaaatcctaaagaagaattacttcatggatatggagaaattcgccacaattaagtttaagttaaaggaaaacataaaaaagtccaaacccttgtcttaagttgagatcgaatggtggattccttgtgctcttgcttctccaaattctccttagcctccttaggtctaagatatgtaaaaagtcctcaaaaatatcgtttttccatgtatatataccaagtagggtcgggcccaaacacatacaccttctactacgcgaaaaagaaaacctttttcggacaaaacatgtgcggccgagcacctgaaagtgtgcccgcgcacttttcacactattctaccccatatgcgcggttagtgcgcggtcaatgcgcggccgcgcacttgccgctcactattcaccctattttgttgggaatttgaaaaaaaaaacataaaacatgaaagttgtagccctttgaattagctttccaaaaatatattgtgaagtcagaacggagttctgagagaaaagttatatgtattttactagatagtgtgcagtatgcctgctcgattcttcgtttgttcttaactatcatccgttgatccccgaacacgatccctgtttaatttcttgggctttttcttagacttcaaagctccaaattatttgaatccattccatagcatctatatagctcggaatcactcctacaaggcataaaacacataattagtgcaaaatattagtgattaaagctcaaactcaactgaagtgcagtaaattggaatgtaataattgacaaaaatatgagattatagcctatcatcaacaccccacacttaaactattgctcgtccttgagcaatcaaaccacactttatatagacacgaccttactaaggcctcattttgtttttttaagattaaaacgtctgaatctgaatacacatctgaatatattaagatgtgtattaagatctgaatagaaataattaagactgtttgatttttacatctgaatgtataaaatttacctttatttgaaaattaataagcataaaattcaaaatgaaataactaatctaatactctatcaatagaatatagtttttaaaaatatgatagttgttggtagtgatggctaacgtataaatgacgactagagacggtggttggtagtagttttggttgatggtggtggttcatgctagtagttagtagtgattggtagtggtggttggtgatagttaataatggcaggtggtggtagtagttgtgattgaggaaggtggtgggtgagtggtggtaggttataatgatgggcactgccggctgtggttgttgatggtgatgtggtggtcagttgtggtagttgagatggatgagtattgattgtgggtgcgaatgatggtggtcggagtggtggggatagtgggtggtgatggtcgataatggtagcggctatgattgaggatgatggtggcgtggtggtgatggaggtggtggtggtagttgagtatgatggtagtggcagcatggtagtagttgataatgataggtggtggtggcagttaataatgaatatgtgatagcatcttaatgaaattaagtctctgttattgatcttaatcatacagacctattcagacccattaagtggttatgaaataaaataaacaaacacacttaatgattaagatctgaataattaagattcagactttaaaaacaaacgcacttaatgtttgagatctgaatgattaagattcaaacctccattaagtgcaaacaaatgaggcttatgcaactctctcgactcctcacaccaagaatatttaaaatagactaagcacaatagtgtaacatcttcacttcaagaattgactcacaagcaccacccattattcacaacttactcacttactctaacatagagatcaagaattaccttttcttcatgaatcaagtgcccttacacaacaaaagagagtagttccaaacacaataatatttaagaacgattaggaacttcaaatagaaagaattcactcactctcagaaacaacattcatatgccacaaaagatgaaccataggcttgcccgtagtgtactattctactaattgagctcattcaatcaaggatcaagtagaacttttaaccggttgtaatgtaggttgcaggacgggtaggatatatttagatataagagtgactacacctccctaagcactttaatacatacactttaacaattgaaatcccacacttatgtcaaaccatatctccaccttaacatcaacatacattaactcccaaattatttaagcacgtttacatcaagattcaccactatcaaagaatatttttcacaacaatacaacattttttctttctttttcaattcaagtggttcttactttttcaaaataatgtacttttctccttatttcaatagttccactcaaaaaccaaaccaaccaccccatacttcatcttttacaaagttcataacaaattcaagtgctcacgagaggtacaaggttcaaatagattgtcaattcaaataattgggtaaggattgtaatgtggttgccaaagaaacaggattacaagctcaaagggattaactaagatacataacaattaggtggtaaaagcatattactgactcaataaagaaatgactatatcacttcctagattgaacaaaactaccatttcgctttgcaaacacacggggcaagttctagacatcgaatacaatgcacagaatatacaaacctcacacacatgacacataactcactcaggattgacctcttaagacactctagtcaaagcagttaagcaaagttaaaatcatacaattaaggtacctatacaagagtcaaaaattgagcttaagcgtcacaactaaaacacttactattctcaaggcataacaaagtcaagagatattactttcatttcaaaccatagcacaatgtttcctacttctaacaaaaataaaaactaactacacccggttcaaacaaaacccttgaaaaataatcgcggcacaaagaaaaatcaaggggaaattaatacactaactacaaaagaaattttttttgtttttttctttcgacttaattcccttaagaaacccgtcgaatgatatccatcgctgggaaaaatcgaaaattttaaaaaaattatgttttttttcaattttttttctaatactcaaactagcaaaagcaaaaacaatcaagctaattaaagaaaaaactaagactaatctacatacaacatacaaataacccctaccccacactttaagttgtggcatgtccccgtgacacacaattaaaaagtataaggtagaggaaacttccctaaatctctagtcggggtctgaatcaaagtcgggctccattccaagcgcctgaactaatgcgcacatccatgcagacagcttcttctcagccttcttagggtacaccccacacttatctttttcactaacagcagcgttcttttcacgcccttcgccttccactcaacacttgcagttggcttctcctttttcactccagttactacattcatctcaaaaatcaccgtcttttcgctcactctaagcatgagttttctatcatgtatatcctgtatagcactacccgttgctaaaaatggtcttcctaagatgagggggacctccttgttctcctccatattcatcactacgaaatctacaggaaatacgaacttatccacccgtaccaaaataccttctactatcccctcgggtgttatagttgtttggtctgccagctgcaaagatatttgtaccgaccttatctctccaatctccttctccagtttcctgtaaatagacaatggcattagattaattgaggcaccagaatcacataaaagacttatcaaaatttagagtgcctaaagaacaaggtatagtaaaactccctagatctccacacttttgtgggagtttattttgtaagatcgcattgcaatgctctgtgagcttgaccactgaggtctcttctatcttcctcttatttgtaaggatctccttccagaatttggcgtaagctggcatttatgagagaactttttaaaatggcaagtttacattaacctgactcaacatatctagaaatctctcaactgcttgtccaacttttctctatagagcttttggggaaaaggtagagcagacatgtgcttgctcacatcgtcagattcctcccatcttgaagtttcctcctccttatttttctcagctcccttcttgccttttttcttcttaccatcttcaattttcagctccttcccactttctttttcaggcgcaacttctttttgaactagagtgggatctttcaacacttgtccacttctcaaggtcacatcatttaccgtttctttggaattcttttcagtattagctggcaaagtacctgggattatctcatataatataattgtaatttgtcccacttgtctctctaaattacgcaaacatgtctcaagttctttgatagcttgcgccgtgagtatctaatctcttatcggttttgacaatgaaggatttcattagatcttctaacccagaataaattggttgttgaggctgaaactgtggcctctgttgattcacaaaaccaagagctccttgaaatctggagttattttgttgccatgaatttgttgtacccccaggtgaactccacgaataatcggggtgcttctgacccattgcattgaaattataattaccaacagcattaatttcctccattgaagcttgacactcatgattagggtgtcctcttccacatatgtcacatgctgcatgaggctcattatgtattgaagctaaggttagcttccttattttttttgccatggcatcaagttgtacctacacagatgtgttagcatcaacctttttaacactagttaatcttcttctttcagtaatctcagagggccactgatttgcatctttagataactcatctaaatagcgactatctcctctggagtttcttcattaatggacctccatttgcattgctcaatgttctgcgtgaggttggtgtcaaaccatccaaaaatcctcgagttgcatccagagttctattccgctatgttgacactttcgcactatctccttaaacctctcccatgcttcaaacacagtcttaatctcattctggcagaagttatggatttctctcctaaacttgcccgctttagctgaggagaaatatttagcaagaaatattctggtcatctcctcctatgttctaattgatccctggggcaagcttcgaagccaatgctttgcatcatctttaagtgtgaaggggaatgcccttagataaactgcatcttgtaacacaccattgtattgaaaggtgttcatgatctcttcaaagtctatcagatgattgtttggatcttcgttcatctttcctctgaagacatagttgttttggagggtttgaagcaacccttgcttcaactcaaaattattagctgcaacaggaggtggtcttacactcgataagccttagttgtagactggtctcgcataatcaccaagttgtctcccttggtcgggagctatatttccgaactagtctattcccacgggctgattctgagctattcttcgagctctctcctcctcataagcaatttgtgcatctctgagtgttgcttcttcaacatctcttgcagttttctctctgagttgggctgcctctctcgcagccaaatcaacattctcatcatcttccgccatcttttctttagttgaggattgcccaatcgtttttgtattctcggagagatttctttcctttctcaattgtcgcctatgtttcttaatttatggttcgtatggttgcaattccttcccagaagatcaggtcatgcaccaatctaacctgtagcctgcggatagtcaaagaacacccaaacgtaaaaagagaaaaataaaataaaaagaaaaagaagaaatcctgaattagcactacaaactatttcaaacactattgattgtcaatccccggcaacggcaccaaaatttgacgagcttgaaacacatacttaaatatgctcgctagtcgaatatagtaaattataatatcatatccacagggattggagttaaatagttattatcgtagtttgtagctagattgctattcaagatgatcaacaattgagaattatgcgatttaaaactaaaattaactaagagtttaaactattgactgatgacaaacaacgcaagtagtaggcaaaggaagatatcaattgggagaaaatatggttgataggataggtgcaagacaattatttgggatttaactctagataattcacttctaatgttcaagtgagtctctcaaattcacttggttattagttcaattgtttagtagaaactcctctctggattaagtctcaacctcacaagataaaccaatattaagtatgtgaagatatgcaagaattcgtagtggattggtctttaggagaatctctctcgattattctcctaactaggttcaatcaacaattacactagcctatttcgattactaagaagaattaaagacttcaaccaacaaaatataatgcaacaatatcacaagttgtgcctctctcgattacatgaactagtgaatatagaagcaacgattaaaacatccaaaacgattcaatacataagagttagagtatattatccacaaacaagtatcaatacaccaaatccatcaaaccctaaagaagaattactccatggatatggagaaatttatcacaattaagtttaagttaaaggaaaacataaaacaatccaaactcgcgaagcccttccttccaatccaagccggcgattgtcttgagttgagattgaatgatggattccttttgctcttgcttctccaacttctccttagccttcttaggtctaagatatgtcaaaagtcctcaaaataccattttttcatgtatataccaagtagggtcaaaacatacaccttctcttacgcgaaaaaggacacttttcctggacaggacatgcgcggccgcgcacttttcacagtgttctgccccatatgtgcggtcagtgcgtggccgctcacttgtcgtgcacttttcatcctgttctgatgttaattttaaaaaacttaaaatatgaaatttgtagccctttgaaaagttatgtgtattttactagacagtgcgcagtatgcctgctcgattctttgtttgttcttaattatcatccgttgatccccgaacataatccaagcttaattctttgggattttactcatactttaaagtttcaaatcacttgaattcattccataacatctacatagctcagaatcactattacaaggcataaaacacacaattagtataaaacactagcgattaaaacccaaacttaattgaagtacaataagttggaatgtaataattgactaaaacatgagattatagcctaccatcataaaactatcaattcgtggggctttatcattaggtaaatccttgaggacctaagtgatatcctcactagtgacagactgtataagttccagctgttgtgctctagtgagacaaggtccatcccttacaatgttgatgtcaatacatggtaattctgcagcactagtacctagaagatcttgggaaaaattgacactctttttgcactctgtcaggatctgttagtgtcacacgttggctatcacaaatagtggcaatgttgttcctggtttatcttgctttaagttgtgcatagaagaactttgtattggagtctccttgcattaaccatgtagctctagattttttttctaggtaccctttcacgaatatctgaccatttttccagggttaataagacttctttctcttccttgatgagaagaggattatataggtcagtttctagcttctcttgtacagattgaagcttgccatgtaacttctctattctgtggtccaacttagacacttctctattcatatgtgtcacagcaattttaaggagtttcaacttcttgcatattgcatacacagtgtgaccagatacattttgtctctaaatagactgtgtggttgctgcaggtgcttcatattttagcaggacattgaagagtctgaaaggtcgaggcagtgtatgtttagccacttcagtagatattagaattggggagcatcctagttggtgataatataccacaagggtgttgtatttattgaaccagtatttattaccaaaggcccaatctataaggctgtaaattctatctttaggatcacgcttgttagaccaggaatattggtaccctcttctacagatttgaccaagccctatatcttcaacacaatcctgaaagtcttgcacatctgcctgttgcacaggtgcccccattaattctattattagttgtcaaaattatgttaaagactcctaatactatccaaggttcaatcatggtagtattgatcaacctcgcctgttaccagattttttcactacctgacactgtgttgaaaccatatacaaaggtggtatggcagctaaactgtgaccctttgtccttaacttgacaatggacaatttgggctccagttattaggattttaatctctacaggtgatggcttccagtataaccagatccttccatttggagctgagatgtaatcagttgcaatttctcactcttttcctagattcctctttaccttttcaacccctttaactctaactttagtctctagacatcccattagaaccactttatttgtaagaaggaaggatttaaattccttctgcttgaagggcttgttcagccccctaatgttccatgatccgaaaatcatgggggttctgtactattggagtggatgtccctcccactgtattagtggttacttctggctgaattctaagagcaccaaacctgttttgagtcaatatcctttccataacctcagtttgtgaaggctttcgaagttgatccatctttgctttccctctgtctttagagtggatttgaccctgttcatcctcaattgtagaagaggatggttgatcgacttggttgaccacttttgggatcacagctgttggttcagtctcctttggttgtactggttgctttggtatccattcctgcttcttctgccctttcttcctggtatgcttctgcttctcaataggggcatgatctgcaggtactgtcttgcaagcccctgtctttggccaattcgcaggcagtcttgataatatagaggtcgccattcatactccacagcttgcattctttccccctttttaggaatttaaattgatatctcatcaggtaggggttgggagatatcaatttgaatgagtatcctagcataggacaccctagccccttatgaagttagcttatccgcacatataggttttcccacacagttggccaatcttactagattttctgtcgcccaatattgaattggcaaattaggaaatgtgacccacagagggatgagttgtgctggttcattctccattagaaaatcctagtcccactgcttcaatatcaggggtctgtagttgaacatatagggtccagacatcaggattgcgctcttgtcttcctcattctcaaatcggaagatgaaataaccatcattatgcaaaaacagttgtggagtacagacaaagttccaaactccatagacatatttcaacatctccttaaatgaagggtcacctcctataacatagccaatcaaagccgattaccattttttgctttgttcctctatctctactaagtttaacttagcaactttgactacatcttttaagacagggggaagtaatcaattttcatactcgtttgctgagttctgtttcctttgacgatgtcaatcatggtagatttattagaagtccctttagctgagacattagcttccaattccggtgatacttcttgtgcttgcatcataggggccttttgcagaagaattggagcactctccgttccaatttcctccgttagactttctaattctgatgtcgaaggtttccctttcaaaatcgttggtgcactcccattcctgtcatctattgagtcagctgtagaggtgctagactctatggaataccagattcaggggttatctacctagtcgttgctgcttgcgttttaggtgaggtagggctcgtcgtcattttcattgagtcatctggatggtgcacgttagtaaaccctaactaaatgtgcgctcctacttagtactatacatttactaatatgacttttattaacttgtcaattggcttaatattttgacaataattctcttttaatataacatagatacatattgtcttaccctagaaatattcttatcttttaaatctcattttactaatattatagatttttttaattttgaattttagatataatcaaaatactatcatatttaaatcaaattataattttgaatttttaaaaaatataaacagataagtaatcttactattttgtcataaatttactgatattcttaataattgatatttttgcattattttccataaggaaatggacttttgttttatttccatctataaattcaaaataatatttttatttttaaattcgaaatcaaattattttctatataagaaaatatgtgtagtattttataggtatagactaccatattagaaagaaactactccccaatttgaattgacagttttgtttttcttatgttcattttttattttagaataattttaaaaatccaaatttgttaactcaaagagagtaactaattattagcagcacataatgcataatttaaatttttgaaaatataaattcagaaagaaaactaattattatctaacctaactaactttatcctaaattgtcaagtggcttattgtgaggttgtcgcttgacttaatgtgcaggctttttcctctccttttagtaatacatagtagatttttaattattgctattatgttacctaatatatagtatttcatgttttcatgtgaccttcattaacttttctctttatttaatatcattatccatttatatcctttaatataatataaatcaacatgtaattttttaatatatatataaaattatttaaatttattaatattatttttaagtattatatagtaaaacttctaatattttgatttacttatttataattaattaattaagaaataagttatatgtggctttttctggttatgacatatggctaaactaattattagttaatttgttatccaattgttatttaagatatcctagtaaaactttaatttgtggtcctattatagttgagtgtttttaccataattttaatctaatctcaagttcaaattatccttctcgtctatttctaatattaaatatttttgaatttttaattattgcgattacgttagtatttcatgtttttatgtgaccttcattaaccttcacgtgacctctaagtttctaataaaatcgtatcatccaacactattttgagaaatcttgtatgtcatttttgaaaaaatgatgatactttaacattgcaacttttgcaatttgttcggttcctttaaaaaattttgaatattttatactaatatttattttccaaagataaattaagtatgttcaagcataaatattagacatgtgaaagttgtgcatcttgtagtacgtaaagctctaaaatactatattgcaatctatacatttacaagtacttgtcaggttttatgtcaaacattggacaagtctttgaaatcatggagttggatgtttggtggactaccagaagaccctggatattaagagtttagacgactgtacaacagtcaaaaatgcaaactgatcatacaggcgagtttattgattcacttgtcacattgtacaacagtctaaaatgcaaactgtgacattgttacaagatttgtgtaagagtttattttctagtttctctgctgtggtcctatcccttttcctagctgcctccgtgaaaaaaatgactccgtttactattggctaataggcgatagctgttttttctttgttgcctcagatgatagtatgacatgacctaagtggacactgcgtacttcaaaatcccggtaaaactgagaaatctactattccccttggcaaatctgctattttcttcagcagagcaagccggtttgtcctgatccgttcgtcttcctgcaagatgcatacagaacaattaatatgaagaattagggaggcacagctatacagtatacttgtaccagcactggacaatcacggacaaactacacttttttaagattgagagaggagttatgttaacaaagataagcagatgggtgcatgcaccaagcaaggaagccctcccccaataggatgctgaaaagaataaactaagcaaagcaaagatgatactactctatccaatgcgcttataaaaattggttaatgcttcagaactatttaagtttttcaaatctaagaagtaaaaagaaatcagaggatcttaccaccattacaaagacctcgttgaaaaaatcctccagcggttctataagaactgacgatgcttcaacaaaatcatcaacttccatgtctgtaaatgaacagtcatacatgcacgcttcacttgcaaatatgttggtaaaaactcaatcaactagctaaatgttgaatgtatttacaatgcaatcaatctggataacagacagctatatttgtttgaatatattaggaaatgcaattaatctggaggagaggcaatacctggatgagttttacttcttagtgacaagaaagtgctccacaaagctttttcttcatttgtttcaaaagcttgatcatccacctgaatttacaatgagaatatgttttacttgataagaacgaacaacactaatagtcagccagctaaaatgggagtccaaagctacacatcgtcagatgaccatggagcttgacaatattaacaattgtattaactagtacagcagagcagatcagaaacaaattatttatagttgagccatagagaaaagcttctactgtcctacataacacctcagtaaatgccttttgcataaggaacaccatttcgttacaggtgcaattgacatgcatagttattctatacaggaaaatcaatggaatggcaacagagaatgttgcaaaacttgtataatggagtataatagcaattaaactatacaacgaaatttgttgagcatagaataagattcacctccgcatcgacatttgcatccttcccacgaacaattcttgttggacgagaatatgcttcaacaaccttaggcaaaagctctcctttggacaaggactccatctacgtatgatggcaatgaatatcaattacagtttaaaacatcacaatactcactcattgctccaatcagagccaattgtacactttatattcaacacgaaacgaagacaaagtacatgtttaactgcaatgaaacaatttccaacactcggccacattttgaagaattaaagctcagagctcctgggttatattttatatttcttgtttcttgataaagagtaatactttatatttcaattacacgatattcaaatacagctgaagaggtaactttcactatgagtacatgcaggaaaatttacgaaaagagggttaaaaagaacacatcatcctcccaatttatgtggcattctgatgcgtctttgtccaaggccctggatataaaactactcaagatatcatcttgccaccttacgtagaaatcaatgacttaacacaacatattgaggtccaaattgcacatatgcataaactcttttagataaattaaagaattgataattaaataggagtaattcaaaaaatacacaaaacactattatcatgattagattttcagaataattagtgacagaatcctaatgaacatgttctttttttcaattaatggtacaataggacatgttcaaaattacaaactttgctttgaaagtcgaactatggtgcaattggggagtagtacgaaagagtaagttcatataaaattagaaatccttaattttttcggattgtactattgtagagggcagcccagggggagagtaggggtgtttggaaggagacaacagttgaacatctagtgcagatataacatattgcagatgcatcatgggaacatcaaactcctgaacgttcagatgtatctctaacgcgtccaatttttcaaaaggacactgccctcgagcagttatgtggactacatgaactgagcaataaggagctttgaagagaaagaaaactcattagtgcatttacaaaataatcaaactactattatattttagatgtgctaatgaaatttcaacatgtatgttgaagtgtgtggccatctcatctaaaaacttaaattgttagagagagcacgctttatttacttaattgtctcttcaacaggcgccctcatgtgcaggcttcattcatttttttcattggccaagtacgtggaaattcattttttaaaatggtggtggtgagactcgaacccaggacctctgcctgctttgaaatcatattaaagataggtctaactcattcccaaaagctagctcgtgagtgagaattatccaaggccatataaggagacaaatggcctcccacacccaccgatgtgggactcaacgcctccctcacgcccaggcctgcaaattggagcgtcgacaatataaatgggggcccaacatcggtaacgataaatcgaggttaaaatggagtgggcctaccaatgttgaagtgtgtgatcatgtcatctaaaagcttaagctgttagagagagcatattttatttacttaattgtcttttccacaatgtataacggattgaatggagaagagaagaactccttgcaccttatggatagaggatattctgacttttgttgataaacataaatagaatttttttcaaattgccgtatgtaatagaagaaatgttgcctcttaagatatgaaagaggccaaaagtatcagcaaagcataaaacaaatgagtgcacaataaaaggaaagaaaggtagttaccttgtacaccgatttagttgccaaacaaggttgacttgcacgctcggaaagaacagaccttacgacttcagggcttatacctttgtccatctgtaattgaaacgcagaacatgtcaataaggaaataaggaatggtctttttcacatggataagtaatggaatggaaaggtctcaagactgtcaataaggaaatgatcatactcttcgtcacatggataaatgataaaaaggatcactgaagagatcaaaattatcccatgatgttcaaatactggacaaaaagaaacttagaactagttcacgtgctaagatctggaaccctagaggcaaagctaaatccaactccagataaaacagggacataatagaaggaatactaactgtgaaaagaaaaagaaaagaaaacgagaaaaacaaataacaacagcagaataataggtgttcatgaaaatgagacataccagaaattgctctagtcttcgtgatacaaattgttgtaccttaaatggaaaaaagaaaaagatgtatcttgtcagattatgactcctgactttgtgagaataagcaaaggaccgattgcatcatataaaggacgaaagacttccaatttatcattgaagtttaccaggattaacttagtattactagtatatagcatatttaattttctagcatacaggaccaaatagggctagtgaatttttcctttatttcaacagaaccaagtagggctactgctgcaattctacaaactaataaacgaatagggtgcaatcttacatcattgattgtcctgacatctacttcaatgggctgtattgcagcagcaaggtctaaagcctgtcttaagtctatatttttgttactttcaaccaagagttgcacctgcaataaaacaaacgcaagcattattttacagttctttaaatgaacaaagtttttcaaagattaagacatacaagaccatatgagatccttcgcaggccaaatggatcattacttgagcttggctgacagccagcagcaaataagccaacaaggctatccagcctgcagtagagatagcactatatgagagacgaaataaaaattgggaactgcacagtcaagagaatgagattcagggaaagacatttatcatagtgtcactaggatattaagtgcattggagttaaagcacgtagaagtattgcaatataaaaacaaccttgcatacgatatcagtggtagctaatttctaagaataaccaatttgaggcaagcaggttagtagagtacggactacaaatcagaataagattgcaagtacactacacttttcgatgcatttgcaaatttctccccaaggttaatgcaaaacacgtgcaacatctcaactacgaatcattctacactgatctcaagcaactggaaaaatatttgcaaaaaaagatgtcccatatttgtttagaacgctagaggcaattcatgtgacacgcagtgacatgaaccatacttttcataatcctaatgaccatctagaaaacttaaactgaaaggtgatcaacattagtcatacctgtcagtaatagctaaaacggccccaacttcagtttttgggagcatatctccagaaaatcgtggaagcgagatctcaaacaacgcctctgcaatctgtaaagcacaagacagcgaatcttttaatgtagtcaacgaacatgaaaataacaccaaaacaatgaaataaataacaaaagtttactttattataactgagaaatcccggaaggcaagggatacacagtttggaactcggtggataatgggtccaccctactacccttctccacttaaatatcaggcttttgtctcagtagagttcgacccggtgacgcgcgcctaacccccgcatcacgtgttgccctcttacaactagacgaaagccctaggggctttcacaaaaggctacatttttataatcaaaagagaatcaatgtaacaccaaaataatgaaataaaccacaaaagtgcgaatctacactcttcttaactacgttactcaaactcttcaaaaatgttgttgggtatgtgtcggatcctcaaaatttattgcatttttggaggacccaacacgggtgcggcagcacttttagagagtccgagaaacatagcttcttaatcaaagtgaagaatctacatacaaagttaaacaacaggcaattctttgaaatagtgaacctttgcctcagccaagtatatcattgggacttaattacatgataatgttattaaatagtaattaagcaatctattcaaaaatcactcagcaatattctgcatcaagcctgtaacatgtgatttgacaaagtagaccgcaactctctgtgaaaacaatccatattgcattgcctttgccgcatgaaactgacatcactatgctgttacaagagtgcatacacatgaatgcaaacatattaagccaatggcgaaagacacatctatgtattccccttaatttattttttctagcctgcagatacctggtcctcttctctgtactcgtccatattaaaagaaattcttctcttattcaaaataaaaggatagaacaatgaaccctcaagtattgtcaaaggcgaaaagctctaaaaagcgctataggtctactggggctttaagtgcaaatacaatttaagtgtgcgctttgtacaaaaaaggcacaacgaaggaaaaaagataaaaatatatatgtaattaaagaaaaagtaatgaattcattcataatgttttccttaaaaagaagtacacttatttgccgagtttgtgttatttagactgttcgattcaagatagaacttatgggcagtgaagtgcacgccttagttacttgactacatcgaattgcagcttaagcgaggggaagcaccctccctgagctttcctgagcttcaaggcttaagcacgctttaaatgagcatttgacaacactggaatcttctcagcatatttgctgcaaaacttcctctctttgaaataaacctcttctgatgttgattattgctgctaaaacacgaattaaacattgattccaccggaatttgatctaagtgaaggttaaaatccaagagaaccactcctgttaaaagagaaaaagatcggactaacttcatttcctcagtgctttggaagacactttttttgcagtggtgctaatataacgattaaaccacagaccagacataaggtaatgtacatttagaataaacacatatgtatatgatcaattagcaaatacaattagggatcgtttggtatgaggtataagaaggtataggggtgataaaaatttaataccaccttaatattctatttggttagcaaaccaggtataaattatcccggtgttaattttaacaccaggataacttataccttatagagggtggggtaattagcaccagtataacttataccttattcttagaaattatgcaattggcattcttaatacaacataccaaacagtgaataaacaacaatcccagcataacttataccggcataaggcatattccaaccaaacgaccccttagaagataattaacaacaacaacaacatacccagtattatcccacaccgtggacaattagaagataatcaaaaaccaaaaactaggattaatcgaaaattgaagtctcaacttgccacgaaaatatccataaaaatgtggttctaactacctcctctgaatagccatctctaagtgcatagtggcgccccattgtccctgagagagaggtaaactctgtaacaactgcggttgcaagatctgcattggctaatgaggctgcatcttggatgacttttagtttatcttcgcctattccaagagacaacccaacttcactaaccaaattctgaactcgtgacattttatctaacatagttcctagcttctcctgcatagacaacattatcattttgcaaaaactagatcagcagaaattaagggctaagaaccaacaaatttgcttcaatcactagccagatataccatgtgagactatggtctcataacaaaattgttcaaagcactagtcagatatacgatatgagattatagtttcatatgtatattcatttaataagtgagattcagtaattgcaccaagaaagtgctggtatgtccatcaaaaagactaatttaagatttgatatattatagacaattctacaagacttccttttcacagaataaagaattaaatactaaaccttgtatctatgtttaacaataaataagaattccctgatcagagagaccaacaaaagctgcaattatctaaaaaaaagaaaagtgttaagatggaaatctaagacttacatggaaaagaatccctttcagttgaggacgaaattcagaaaattttctacttgtgtccatctcgtagaaaaattttgcatcttcaaatcgagctctgcacagatgcatatgcagttcatatctttaagcacataccagttatcataaagaaagctgatacaggatcaaagtgaaatcataaaaggtgcaagtatcttatttgagcctgcttcgactcctgcatgtagcacctagatcaaaactttagaatgttcagggaaagagcccaactaaaggatagtaacctcagcacagcttcatttccttttctgactaccttgtcatcaattgatccatttgcaacctgaaagatcaaatccatatcaagttacagacacaaattaacatctcacgttcagctaagcatgccactgttttccacagatacaagatagtaaggatttctcaccgtgatgaagtacggcaacagtttaccgttctcatctgtcatggcgaagtatctttgatgcttctgcatcacctgcaatacgcgaaacacagcttttagataaactgactctaacaggacgaagagctccagaaatgctcaaaaatagccatatgcaatagcaaggaaaatgacaaacacagaatgtcattcttaaaccagtaccctcaatgaccctgcagtcaaggcatgcttgatgacagttactagcacctcaatttactaggtaggggatgataacagatatgcatggaaccatgtaattcttccctgcactgcaaccggtaagcagttatatatgaattaagctattactttttggatagtccgaatgaaagaacgagaagtagggatatgttattattttggtccaagaaaggactgttgagtgttgacacatatagtgtttaatcctaaagaaaagctcttatagtatttcagcctacactagcagaaatattacataatcttcccagaactgtagcatctaaatttctgatcctgagagagagatgggttaaaaagggattgcccttaagtagaatttcgaaattcttattcccatcaccagaggcattagtattttctgctcaaccctaataaaatcacaaaatgacaaaagggacaaaacaatttaaagttccagagagtactcgagtttaccattataagaagctcctttggaagctctaagaaggagtcatcaaattcgccaagtacaggtagtggtgcctcaacaagatttacaacctaagcatccaggaaaatgcttaaatactattcgtctgacgattgaatagaaaaagtctgaaacttcatctgttacctcatcaagcaaatcatttttcattacaatatggccatgtatactttttgctaaatcatttgactgctccataattgtcttcttgcgttgctgatatttgataaaggttgaatatttcgaaaaatcatcaacaagcataggaaatacaaatggaagttcatacaaaacttgaattaccttgacatcaacaagaatcccagcatcctgcattacatttgcataggtttctgcatccaaaatctgtagtattttgttgagagaatccatcagagattttgcttccaaaggtaaaggaagtagtatagtaattctccttagaaagtgaagctatgaatttcaataaaatatttaaaatagagacaaaggaaacaagaacttgaattgaatgattattaaaaacatatataggataaggtgtattgtgggccgggcccatcccgggatcggcccgagaccgcgggccaaacgggctggtctcaaatgggccagtctctaatggtgcataagcccgaagcgggccggtccaacccaaatagcccgtgagtccgggaccgttaagcccgggaccggcaggcgggcctgggccggttcaaccgggcctaacgggccccaatggctatttttaaaatctagccgttggtcttcaatttccaaccgtttgggagtttaaaaatagccgtttggttcctaaaccttgtccgactagatggaattacatgtatgaaagtttagttgttgcatatgaatataagaacccaataagcgcaacatataatgctcgtgtaggtgatggtgatgatgatgatgagcaccttacaaatcaagattggagtaatgttaaaatgcttgtagactttttagaacaatttcatgttgctataaatgaattatctggccaatattatcctactatttctaactgtttagtttatattgcagcacttgtagatttatttactcaattttcagagggtggagtaatttatcaagaagctattaattctatgaaagctaagtttaaaaaatattttttccctatccctctatttttggtgttgctgcattgttaaatcctacaatgaaattaggaggtcctcacttttggtattcaaaaatttataacgctttatcactttcagccgaggaatttgctatacttggagatgcaaaagcctcagttaaaataaatgctcaaacaatttataatgcttatcaacttgtcttagatcatgctaggccaaatgttccaactcctacttcgtctagttcgcaatcatctaaaagaactgcgggcctaaaagccctttgttcttggatggagttcaggggttctcaaggtgataattttggtgatagttcacaactaaatgagcttcaagtttatttgtcgcagggacttgaatcagagaatcccgacggctctttcgatgttttggaatggtggaaggacaaacaaacacactatccggttctttcaaggatggcttgagatattttaagtgttcaagcttcaacagtggcatcggagagcgctttcagtcaggcgagacttcaaatcggtgatcatagagcgtctatgagggagagcttggaaaaatcagtactcttcagagattggatccgttcagaaagaagaaattttggacttgcagaatcacaaccggagatagatgaagcttatgaagaaatactagcggaacttgcgcaggatgctgcttcgcccggaagcggtgatgaacaagcttcttttctaccaccaccaacagaaattcctccggaccttgaaggatttatgagatttgttagagataatacatagactaatatgtaacttgtattttggcatatcttccttagttttttttcctttgaatggtggtattagtaccttgttgtgctcattccattgggggaggaagactaaaatagatattgtcattctttgttaatgtcgtaataataaaaattataagacattcccttgaatatttctttgcaatttattttgtgtttaaatttgatatagtatatatattatatatctaatacatacaaactatatatatatatatctaatacatatatatatatacaaggcactatatatatctctaatacatatatatatatatatatatatatatatatatatacaaggcactatatatatctcaaagtgtaaataaactatatatatatatctaatatatataaactatgtatatatatatatatatacatacatatatataaggcactatatatatctctaatacatataaactataattttatatatatatatatatatatatatatatatatatatatatatatatatatatatatatatatatatatatatatatatatatatatatatatctaatacatataaagtgtgtatatatatatatatacatacatatatataaggcaatatatatatataagctatatattatataaggcaatatataattatatatacacacaatacacccttatatatacatactatacatactatatatatttatatagctatatataagcaatttatattagtatatacatatatagtttacaagaaattgccttagataaaaaaattaaaaaaaaaaaatagcccggaacaaaaaagctcattaggcccgtttaggcccgtgggcccggtccatttagcccgggaccatgtgggcttaggaccactgtgggccggttccacccattgggaccgtgaagaccgggactatttggcccgggaccgccaaagcccggcccatcaaggcccgagaccgtttggctcagcccgtttaggcccaggcccggcccacaatacagccttaatataggagtcttttaggctatgtaagacataataagtaattagtctctacattggtaaatattttttcttgatggtaacataattaacagtgggaaaatctcgctattaagaaaatgtgtcttgggcttaactcaacctcaaaagacaactcatgagataaggatcatccaagaccatctaggatacaacatcacattccctcaaccaatctaggacacttcacccgtcctcccctggacgtccacgagtggacatctagtgcggggacaacataacgtgggagcctaatgttgggtaaaccaagaatagggatgggtttggctctaataccatatgaaaaaatctaaacatccaacccaaaaccttaaggcaacaaatggcgtagtccaaaaccattaaaccccagtggaaactcttacataaccgatgagggacaagtatagaattccctaaccccctcttgcacatgtaactttgttcaaggatttagacatggattaaagacttaacatattgtttctttacttcatcctttttttaaaggagatataataatggaccggatgtatagatagacagagagggttagagagtatcaaaatttcaactgattggaccactaccctggatgtcaaccatgttaaaaagcatatattttttggaaccctagggatccagctgatgggtgagaagccagattcctcactaataaaaagcttgggataatacgccataactatgactagtccatgctcccgtactcacgcctacttgtcctggctaacctgtattataatgtgttttatagagcatttcattcagaattctacgacctcccaaatggaagtgtgacattttcactatcacctcccttcaacaagcatgcctctcaatctcaaattttcatagccactttcccaatagggccttatcataaactttaagatctttcacctcaaggcctcaccatctctttaagaatggtaaccgcctttcaacataccaaaaagaggctttcttgctccatcttctatgaaaataggaatttcattaggagtatttccaaattccaatttacttaaaaagctggcctatacacaatattcaaacactaaagacattctaaaatagtcaaatattgtggaagaaacagaaaagagctgtgacaccgaaccgaccaccagaagagacgagaccagtgaaactatgaaaagaacgaaaaactctgtctaggcaggcggtgtaaggctgactgccgaaggcaaaagctacttatgcctttaacaaaaacgtaacggttctaaccttctcaagaaaaaacacaagatcgtaatggttctaacaccacgtgaaaatagagaaaaaagaaaagagcagttgtattaagttggatatcaacaatgtacaagaaagatttcttttctaataagttatataacttcctaatgttcagacataatatcctatgatatcttataaaatacaacggaatattgtataatagtcgcatactcaaattcaatgactctaggcatattttgcacatataacaatataaattcccttgatattcaatcgtaataagagagaacacatggcagatgcaacaaaaggataaaaatatggtgagaaaggcggaagcgaaatgtctacaattttgttcacagaccttaactgtagctgatggagtattgcgtagaccatgagatacatttccactgtaggaaaataaacaaataagtagtaactagtaagagacaaaccaaacgccataaaaccagtaaaaaactaaaaatgaacactgaccacataaaatcgggaatactactgataaatgcacaaaaatatatgcagtccaagtttttctcgaaaaaatgtgcccccggtgtgtattttgaattaccaagggctgtggcacaaattcaagattttgaatttcattaacaaatctggtgaactccaacaggatgcattctgaagtaatttgaaaaatgaaaatcaaagctaaaattactgcagcctgctgagaatgtaaaattatggtagttgtaaaataaggaaatactggatacatctacactggaagtttcacaggaagaaagaaaaagacaatcaagtgtatcacaaagtcaacttcaagaaagacttccctgcaagtgcgggtgcactgccctaaaatagtcggatattgaaagaaagctgagatcactcactagtttcttctactaaactttcattttcccttcaaataaccacatccaacagagcttttttcattctatttaacattttactgaagtcacttgacaaaaattctcgagactttcttgacagaggacatcaaacagagaattagctgcctttcccccacctgcccccctccctttggtgataggtgagtgcaataggaggagataaatcaatgccaatataatttaggagttgataaattactgaaacctcaaccctcctgttaggcacatttggaataaagtaggaatggaacttcttttgaaccaaaaaaaaaaagtgcaagcaggtgctcaaacttgccttacaactccagcataaatgaatggaagaactacatctccatgaagggccaaaatccaacggatgggtctgctgaatgcaacctacataacaatatctcaatgcacgctatattcatatagaatttatacattcttttatagttatagattttaacaagttaggagctgtgaagaaagaattcaagataaatttatgaatacattttgaagaaatgccaattatagcaattatagcaccagaaaatgaaaaagatttgctcccatggacataacccaagttgattactttgtcgcaatactaaaaaggagaagagagaaagttgaaaggacaccatataatatatacacttaatattcagggttgactgtactttcctttcttttactaatttcaggagggtaattaggactacgaatagttcaagggtgtcaccaataatccgtgccaagtttgggggggtgggggggtgggtgggtaggtattttgccttttgttaggggggaggggggtggtaggtattttgccttttgttaggggggggggggggggtttaggtattttgccttttgttattggaaagagagaaaaaggggggaagaacgggaagcattccaaatgacaaccacgaaaagcagaagttatgtagatttttccagaataatatgttactattgccatatttcaatgccataaaacatataaattagtcttttttcctaacatcaaaaaaatcgtggacaaatagattatgacaaacctctaacttcaattcaaaaagaagaaaggatatgaaaaatcagaaaagaaacatgattggatctctatctacaagaacacacatacgtgctgaaaattggagaaagttcctttaaaagggaaaggacaatgaagaaaacacaccccccacaatccccaaagaaatggaacagaatatcttattagcttaattaggtgtgatattgcatatcaggataaagcaaaacgtctgaacattccaagattgatttttttttccagcaacatatgctatgacagagtaagtattcaagcgatgtaaagagataggtcttcttcatgaataattgcccgctcatgactggaggatttcttttatctggcgtatctcttatttggcctgagcagaattactcctcttcagtatatcctgcttctctatcaaaaaatttcttatgaatgaaaacaaaggcttcttttccttttgacaacaatagggacaagatagctgctaaatgcatttgaaactaactttctggtgaaacctcaatttctcatggtaacagccaaagtgtttctggcattagagtttagttccaacccaactttacatcctaatatctacttgccatctttttcccttgccaccctgcaagcttgataggaaggttaacaagaagacaaattattctggttatagaaaccggtttgccgcataatattccttttttttaaggatcaaacaaggcaataaaacactttataataaaccaactgaaaaagaaaaacacaaatttggtcacgactcacgcatattccaaagacaaagggttagtcaaagtgatagtacatacatccgagttccaacgcatagacttggggaatgatatgctggagattatgacaggtagctcttcagacaaaacctgtcgatagtgactcaaacaatgagatctaagaaaaactaaggaattaaaaataaaaattaaaacatacttgttagtatattataaatttatacagagcaacagaagaactgcacgtagcaacttttaagagattgttcagggacacaataagcatatgcaaaaggctataatttccactggaacggcttaaggttttatgtactattggtgaggatggcataaacgaaactgcaaaaattaacttgaactagtaccaaacagaaaaggttaaatttttcaggtgtcagttaaagatacaaatgaaaagggagaaggtccagatttgcccttccactatgtgaaatggtctaacttaaccctccgttaataggtggggtcaatcatgccctcattataaaattggaacatatttacccttatttgccaactcagcattcggaatcattgaaaatatatttaaaattataaaaataaaaagaaaatagaaaatgaaataagattgggtccttggacgaaagccagcccaagttgaacaaatagctctttgtcaagatttactaccgaattctccaattacagtggtcatttctcttaatctgtcccggaacttgacaaccagtgaccagcaaactgccacaatgtgctacacgtttcttataggtggttccattggtagacccaggtacattgttaagactgatccacccttacaattaagtaatgtgcaaaagctgctcaatgttctctacctctccctctagaataatcgcacatgtattgagatgaactttagatctgaaactacctgaaaccatagcattatgtgcttgaaatgtagtagttgagacacctctgcgtcagaaaacactaacgtatgatgaacaagcatatgatgagatatctatacacttcctacccaccagtcacttcttgagggaacatagtgttgcagcctcttattccagctatttcaaaatggtaattctcagtcctatgacctcgcgttactgcaaatcacttgaagcctcagcataaactataaaaatagtgaacttctttaggagggtgagcttcatcctcggacaaatcaaagtgaaagaagaattttgagtaacagtatatctttggttgcatgcaggatgcttatagacagagaaatgcaggattgacacacaaatagacagagaaagcttcagaagaaaagaagccacaccattttgatggagcttgacgccaatcataaacattaaatgtgcgacagaactattttgcagccaattcgcttacgtggacttgaacaaaggtaatatacacatttccattatcctgttcatacaatcgttatcaaatacagccaaacatcacaaggaatctcaatggttaactctgcaatttgtagcagtagccttggtcacacaccctactaaagttagctagttgctgaaaagggaaattttactttctgatgaaaacatacacaaaacacttattttctcagtgtacctcaaatgcaagccgtgctggctccaccaaacgagcatacacatattctgttttccctgcaatcagagatacacattgaaaacacaaacattgttagcacaaacggtgttacactaacaagtaacatgcaaactattgacacaaaaacactagtatattagcaatgcaacaacaatcttgtaaattaacaagctctgcataagttgattctggctatgtatagtttacacatgagtggcatatttagaaggcctaatcgggatcattaatacgctttagatctatgcaaaattggggagaaaaaaaaagacaaaaaaaaggcgctgcctctttctcggaattgttgtcattttcacctcccaagttaaaggagcaatatttgaccaaaataatgtaatatatcctcattctgaaatggaaaaaagtagcaacttatagtagttttcatgtatttcaaattttatttttataagtgaatgactctttaccgatataagatcgaaaaatccatcaaattagcctcgaggtcaactggagatacatctcctatcaatttttctggtcaataatgataattccaaacttcaagtccatcagcagaaagtgaaaaaagattcaggcaaaataatttagaaaagcattgccaccaatcaaaatggcggattctggttaacacacttaggcactaagatcaagccgacacaagtcatagaatatcaatgaatacattccaagacccaatatttgcttttagtgttgacaaccttcaaataacagatccttttgtcagacattttaacaaatatctgctaagacattgaaaaggtaccataggtttttgaaggtacaagatccttaaccagacactgaaactttgaaataaaaagataaaatggaatagaaaattcagagaaagttatcagattttttagtaattaattttcaggttgacacagataacgaatagcagatcagacgtcacaaaacaaatctaagcagttttccacatttaagcgcaagtattttctatgaatagcatatgatagactaaatgaacaccagaattcacatgaacaaacactgacatcgaaagaatgttcatctgatgtaacgtaccttcagctcgtctatacatggagtctaaagggacattatttctgcgacaaaaaccttcagcagcctgaaagttgtatgagttgataatatcgactatgaattagcaaacacaaactgatcttgcattcatcgaaataagaaacttgattaaagctctgctcaaaattaaatcaaagtctaacaaacaagcaacatatgccaatatagttcttaaggcacattgtaatacggaataaactaaataaaacaataaacaaaattcaattcactccaccttggtaggatttccttccttatcaaaagcttttgaaacaggaggtccacgaacctcaacctcattttccacttgcttaggaaatagttcctcaacgctaacctgcaaatgatctttatcagcatctataaggtgaagagaaaccaatgaatagcgagaattttgaggaactaagttaatgcatggaaaagataaatgctccaaggtcagcacaaagcctatggtgccacttgaaaagacccagaagtgctataaacattgtaattacttttattaacccgattcatttagcaagaaatcagtcaaggcactgctggaaatggatagttaggttcattacatcccttgcataaactataccaaaaaatacgagaaggtcttggatactattttttttataaggtaaattgtattaatcaaaagggagagaactcccgtattcaggaagtatatcaaaaagtagagaatttacatcagaacatgattctctacaaaaggcgcccaatcttttatacaagtaggggctatatgagtgcgcaccaaaaagcgatcaaagataaaagactattcttaagatgtgaaaaaggagactcaatcccctcaaaagctctcctatttctctccccccaaactatccacatgagagctaacggggcgaacctccacgctttttgctttcttcttctacggaaaccgacccagctatataacatctcctttacagcgcttggcatcacccattgaacaccaaaaagattcaggattgccctccacaaagccgaggacacagggcaatgcaacaaaagatgatcaacttcttcccctgagcttttacacatgtagcactaacaagtgtaattcctctctttcgaagattttcaacagtcaagatcattcccctcgccgctagccatgcaaaaaagcacaccttcgtgggcgccttaggaatccagatcgaggagtatggaaaagtggcctcctctctcaccaacatactctggtaaaaggactttacggtaaacaaaccatcaccacgcaaaccccatctccaagaatcacaagatggtcggggcctgtcttgcccatatagcagtatcaacaaatcttggagctccgcaatctcccaatcttgcatgttccttctaaatgagaggtctcatactaccccctccatgctcgttacgaatctgttggacaatcaattccttctggtttgaaactctgaagacgtgagggaaggagaccctcagagtatcctctccacaccacttatgattccaaaagctgattctcctcccatctcccatgccactgaatgcttccaaattcttcatgatgctcctccacatgccacacccgaaaggtgatgtgattgccttggtcctccaaccccctcccgtggaatcatacttttctactatgacctccctctatagggcatgctcttctaccccgaatctccacagtcacttccccaataaagctctattgaataccctaagatcttttactccaagtccaccccacttctttggggaagtgactgtctgccaattcactagatgaaactttctagttccatccgccgcatcccaaagaaaattcctttgaagtcgctccagtttttctgtgatgctcaccggcgcttgcaacagggacaagtaataggtgggcatactcgataaagtgcttttaataagcacttccttaccgccttttgacaaataccgtttctgtcagcctgctaatcttttttcaaccctttcaatcactggattccaaacagtagtatcgcgcccaatgggagacccaggtaagtagaggagagggagcccaccttacatccgagaacataagacaaagcatcaatattagcaacctcacccaccgggaaaatctcacacttgccgaggttgattttgagtcctgatactatctgaaaccactggaggacctgcttcaggtaagtcaactgatccatatgggcatcatagaaaatcagggtgtcctgatactatcttggacactattgattatcagattaccgagactccataattaacccagtgaatcatgacaaaatggattaactaggagacagtaagagcatggaccggcaatatgttcgaaacatacacaaggcacagagcaaggaaagcgacactgagtcaactccaagttggactaaatgaacgtcgcaaagaccggccatcggcaacgtcttccaactatggaaggtgcaggaggccctctaagaagggaaaattgaagtggtgatgaggagaaaaagataaagaggatgacgatgatcacgatgataaggatgtaattgtgtggacctcaggaatcacagtgttggatgaggtggaatacatagacatgaaggaacttcgagatgatgctcacgtaaagatagaaactaagggaggaaagaatgaaagtccagttgtgtgagttcacggattttcctatccagacattctattttcaaaaaaaaggagcttatgtttgtaatttctgaaacttgtcttactctttaaaagacattagacgttccataaaaacagatccggaagaaactggctttgtactattttaagaactcttgtaaagttttatgggatgagttccaacttaactcaaaactcaacttaggaagtggaacactcatcaaggtttggaaagacaagtggctgggaacaatggcactaaaagatgaatttccaaatttgtacctactagcagtagatcaagaatccactgtagaacaatgttcgcagaacagctcttggtaccctcaattcaggagagattttcaagattgggagataaatgacctaatggaataactggccaaactagcacagattactgtcaaaccccagctgaaggacaaactggaatggggggacgggaaatttacaatgaagaaagtatatgcacacctatgctccaacaatgatctgataaacaattggccatggaaactaatttggagaacaaaactgcctcctaaagtgatttgtttcagttgggttgccttaaatgaagcatgcctcactcaagacaatctcagcagaaggagtataccaatggtgaataggtgctacatgtgcaatttggattctgaaagtgttagacatctctttttgcactgtcctttagcatgtgatatttggaacatgttcctctctatttttggactagcctgggtcaagcctaacagcatcaaggaagcatatgaatgttggtgctcatggagagttggtaaatccatcaaaaaaaattgggtaatggtacctgctgctatcttttggtgcatctggaaggaaaggaaccgtagatgttttgatgggatctcaactctgatccatgtagtcaaagcaaaatgcttattgaatttgtttagttggctaaatcaggcacctgtaactagttctgttcaattttttgattgtgtctgatccttagtgatagaatagtttttttgtgtatatgagcagacaccatctctctcaattgtaatcttttgcctgcatccgctggatgcttttaatgaaatctccttacttcatcaaaaaaaaactattttaagaactcttgtagcattaatacaagatttgatattggctttattcttattgagcaactcatgtaacatataaccgctttggcaaaggtttcaacaagaagttgcatgtattggagctcggctcaatcttttccttttttaagttacatggatctgagaacaatcaaaaaagtttattgagaatgctagataaaatgttcaaagataatgcactccttttcctactacctcctttctcgtagacatttcgtacagcttttcaaagcaaaccagactaacagaatatgtaaaggggaccaaccataatgagacaaatcctaccactaatcttcgtggggtgccatgcgtttgtacttccccatgaggcaacctttgtttgtccagtaactgaacaaccagatccttgagctgcaatgaccagcacaaaaaaacagatttaacagagcagtaatacgaccaactaagcggaattgcttgagaactcacaccggatgacatcaaaacaaattaaggcaagaaaatgtagccctggtttctcttttcccacttcccttaccatatttacaatataaacttcagtaatagagatttgcaagtagtaaaaatgaaaatcacatgaaaaagaagatatatacttgcttgcatgcactcgatacatcatttggaggcaactcctcagtcccaatttcaagaacaagcaaccgcggctctgaaggcacctgtatggccggaaaagggtgtgcaagcaaatttacataatcctttagaaacatgtataggttacaaagagaatgtgaaagaaaatctggcaagttatgaaagtcaatgttccataaatatattctggatcacatcaagaaaccataaaaaaatatgcacacaagtactcagtcccaactcgggtaaattaagagaaagtggagatgtttatcctattgagcaaagaaccaaatgggaaaatgagaaggaaaaggaaaagctaaatagacccaatagaaaaggatgaccagtatagttcctgaggattaaccaaagaatatagaaataaaagaaacgggatgaagctgcaactcttttggcagatacacagcaatttatgggcccaaatgatttacgctaactagggaaaggatgagacgggccaaaagaacaagagaaaagaaaagagtacaaagcaaggaatatcagcttctttgcattgttttgttagctagaaacatcagaaaggaaagagattttttatttattttcttattgaactaaaattgtggggcaaaaaaaagggctttctctattatataaacgaagcaatagaaagcaaatttttaacatatccttgctttctaatttccaagcgaagcctaaagccaaaaaacatacctttcgtgctgcctcctccaagacttctctttgaacaagaagatgatcacactgagaaacaacacccagtggatggtcaagagactcccttgtcttcaaccaaaggtgtgcgcattgacgggctaaactgcacagtggaggtaaaaatcaggcaaaaaaagtgtcatttgaaaacttccaatctttttagagtaaagtaatttggcaccgtagttctgatctctttgtaataaagatttactccctccatttctttttacatggcggtgtttgactggacacggaatttaagaaataaagaaagacttttgacacacaccaaaagtaccactagaacttgtggtcttaaatatgtgacatttttgtggttataagaacatgtaattaaatgtaaaaaggaagtttagaagttaaagcttttccagacattaaaagatgaccttagaacagactaaaaaaagtgctataaaaatggaacatagggaatatatattaagcacgatactagaaattggaacttgcgtgagcaaatttttagatgtgactgaaaaggtaagctgctcgatcatcatgccaaaccttaagaaaaacctacaaactctccaacaagatcagtaattaaaagaagtgataaaaatgtctacctacgcatacgcccaaaataacgagcacgttctgtcaccccaacaaagcctctcgaatctaaaacattgaaagcatgagaagttttcaaaagctgatcatacctagcacagtgagggaatattgttattcaatgtagaagttaacacatgaagaaaaaacacaaattcttcttctctctattccgtgaaaaataataaaattattaagatataagtacatacgcaggtattgcaaggcctaaatcaagcaaacggcgagcttctgcttcaaagagatcaaaatgtttttgtatatggtcaacactagcatgctccagataatacgcactcatttccttcctgaaacagaagcaccaattagaatctcttttctaaaaatgacagatttatcacgcacacatactccaaattttattatcgcatagtaaaccacataaaaaaacccttgagatacagataattcagagttccaaattaaatcggaaataacaaaatcttggcaaaatagtctagacattgcctcaatcatatgctattcttagagcatttatttgaaattacattcgtcccaaaggaatcaccatgctcgacttcgcaaggttaatgttgaagatataattaagcaaataaaaagtgctctctccaatagtttaagcttttagatgagataatcccactccaacatggtatctgaacttgcagatgtcttaagttcaattcaaatattaatggactaaacagaaaaggtaaatatttcatttgaaacaaagagaacagttttatatgcttttccagtagaccactacaaaatactaatctagataatagtctaatacaaatcagtttgaaaatttcatgaccaatccgcaatttcaaaaagaaacccatgctctagtgctagtgtctatatctgacatgttgatacacttaggttgccagtaaatatgcctagtccaatttacattcctcctctgtaactagtgctttttttcagacatcataaatgcaaggttcctttacttgtacagttagaacttgggaaagcaacatttatgctcaacaaaaagaaaatgaagtagatattgttcaaatattgaagatagttagagcctaaagaaagaccagataataacagttctgaaagagcaaaagaaaattaatgagaagcaacatgatctatccaaatagtaaggcagtcaatacgcagaaaaaagaaaacgttttggctggagtaggttttttactcattttccagaaaaagctctccatatgtaatgccatctgcatactgaatctttttaaaatgatcaacaccctgcagacaagtaataatgggtcataacaagcaaaatattggagaaccagaagagaaatgcttagttagtttatgctcttcattttctaagatgccggcagtaatgacctcctacatgaagatttttctgctagctaagagacatagtaaatgtagctatcatgctggaggctctggtgcaaaaatagatagataaggcctttttctcctatggtgggagaagaggatgcagaatgtatacaatgagcctcatcatatgtttgaagaagaaaaaggaaagaaagaaatcataagaggagaaagaacaagcctgaaagtgatctcaacaggcaaaattaacctgaagtgacataaggatacgttcaagcccataagtgatttcaaccgatactggcatcaactgtatacttcccgcctggaaaataaaagttaaataactgtatgcgctcaaaaatagaaaaagaacagaatagaaaagcagaaggacaagttcttataagtcattagtagccaaaagcaaatgaaaaatttgagacttgttcttgttgggaaaaaaaggactctaaaactgcagtacactttttgtcagaagagagagaataacctgctggaagtaggtgaattgtgtgatttccatcccatccatccacacctcccagcccaatccccaggcaccaagcacctactagtagttcaagtcaacagaacatttaacaatacagctttgtttcatgcagcaaaagacatcattaatgcaatccaaacaaaaagttggaaatttgcctgaacaaggaaataagtacaaaggaaatgaagtacaaaggagatgcactgttcatgaaacattatatgtgcatatataggaaagttaatcaagagaaagaataatcttacagggctctcccagttgtcctcaacaaagcgaatatcatgtgcattgacatcaatacctgtcaacacaacaaagtaaaatctcaagccagaacggtatctagagctactataaaatatatatatacacgcacacacacaaccgtgaaacttgcacgaatccaccaagtagaaggagaaataacaaaccgtaaagggtatccctatttggttaagtatggttgaatctaagcataaagtcacacaattcttagttatataaaaataagaacaagaaaaggagaaaaagactaatccatttattcaactaacatagaactttaaaaccttctaaactgctcttcagaagaatcccatttaccatttaagccacttaaacagactcaaaaaaaaaaaaaatcatacacttttagttgaagcttagaaggtaagtaaatggctgactatatagagccagtgtgataaatttctctatcctgtcttccttgtatataccaggcttgaattccaggatcgaagtgaaatgtttaagcattttctaggttagcaataacttgtatcgggaaatttgtaaaataaaagaggatatgaaataaatagtcaataggtgccagatgattcgacatgggagaagatgtctaggaagtcaaacttataacacattcagcacaatctcctcctataaagtggacaccacgaatctaccaggtcttgttcttgatgacaaatcctcaccttgctcatgtaaatctagccccttctagaggaactccaagaactcctcaattgccctagacatgttctgcaccctcattttcttccgggatcttatggtacctaaaactccctccccaacacccactgaatacccaaacctgccgttattgtggacatctcttccctatatttgtccatacaatccttcaaatctctgctcctccctattgccctgatttctaatatgagctgcaagtaaaaattctcctttcctcacctccaatttccacatgtcccacacaaatcctccaccttcttaaagaactcccaagtaccgtctgccctctcaaagtcttcagctatcttaggggcattttggatatctctaagaacccaagtaatatcaataacaatgaagtcttcaactgcctcgggttcaacacagactagctagtcacagcctagctagtcttcaactgcccctacccattctccgtcctcttgaagacttttgaaacttgctcttcatttgcggactgaaatgggaatgtggcatcacccaacggcgacaccttcaaatcaaagctacgccacaaggcttttcctcaattcccttttaacatattgttggatatcccacgttggtgaagtgttggtccttcggtctccttatatggtcttgggcaatcctcacctcttgagctagcttctggggttgagttaggcctaaaagccatttctttatcatggtatcagagccgggttcatccacttgtttcacctgatgttgggcccccatcttatgttttctacgctgcagtttcctgggcgtgcaagggggtgttggatatcccacattggtgaagtgttggtcctttgatctccttatatgaccttgggcattcctcacctcttgatctagcttctggggttgagttaggcctaaaagccatttctttatcacatatcaaggcctccaatatgaagcaaagtatgttctcttttatgtgaataatgaatagaaaaaaactctagtttcgttggcctattcaagcaaggatgctcaatcacctatatggcacatgtttccttcagttcatccttgcaattcttcctaatcacattttccagcaacaggttctttgcctcaaccttatattatattttaatcctacttcgaactctaaatttgtgctctatttctaaaaaatggttgccacacatgccttttaccaagcagatcagagacatatccaaattcagtgaccacggcattctagccacaccacaaaatcaaaaaattagaagaataaaaaagaaatcatggaataactcctccattcctccaatgcttcaaggcttaaacatgggatagtttgcaagtctttgttattggtaagccttacagtcttatcacttaccataagtatcaaattgacttatcccagaaataacatcaacttgaagttgtttttaccacataaattagtccaaaagacataatgtaggaaaaagaaaaagaaagtagatataggttgcaaaacctaaagctgacaagctacggatgaacaagtcctgcgaatttcctggatcaggcttcaaaatcacctgcattgcagttcaaacaggaaaggcatctggagtagtcaaaagtacaataaaatcatacaatagtactaaacaatcaactgtgattcaaaatgttagacaataaattgaaggcaaactaacctgaaattgagtatgcctttgaagcctatttggattttccccataccgactatcgtctggacgaatactaggctccacatacctgccatcagacacagttacaattgatagccatacaagaaaacaaagtaatgtcttcgcttcattgctaatatgacatcattcttcttgctcattatcaagattatgagaaccagaaaagagaaaatgaagcacaaagaactagatagtgaatcagttacaacaggcacttccacaggcacacctcaacaaaataagacttatccattctctgtgccgaatttattttcatctagttagaatgacaaaaattccaattcttctgagaggtgggaaaagcatgataagaaaaccatctgaaattagcaagaaaagaaatgagctctgcatcccaaagctcctgtccgattttataggggactcaatatctccagattctaacagttaccatgtccttcaacttaatttttctgcataaatgatttattgtgtgcagaacttttggttcaggatagagaacatgacatgtattcgtctttttagattaagaagatcatctccaaatatcagaagccctaatatttaagtcagcgtgtagcccatgttcaatcaatatttactgactcgtgacatgaacagcattattttagcttaaatagagctagatcaccacggaagatgcccccccccccctactttgctttaggtggcaggagagagtaatgacctaataaaactttgatttcttttaccttacaaaggaggaacaaaagagaatcttactaaagagtggcaccaggcaatgccaacccaggagcaacaagagaacttattgatgccataggtcccccgtttcttcatgggaggacaagtaacaatgactaatatgttactttgcattaaagagactatctaagatgtgcacgacttccctacgcatttactctcttcttctaaagaattctggtcaaatatgagaatgataattgtattcaagaactttagagatgaaattatcaaaaaatcttacgcaacattccatggttctggtccaagaacccttaagtatgttagaggattcatagtcccagcgccaacctggtcaatgcaatttaaacttaaacaagttagtaaagtagatgcaaaaaactctaaagattgtaagttcaatttaaacacttaaagatctaataaccactaaaagcccattcatgttatggctgtacaaagcactatcatcaccaaccatatgtaagtgcaatacatatctaatccagattaagtgcgatacacattacatataaacatgcagtcccaaagtacggaaggagaatatgctcagcatttcctttcagttttttttcggtaattaaaattatcattaatcaccaaagaacagcattacaaagcacagcttagctactcccagctagctagatctcaaagaagatacacggaagactatatctaccaagatgcatttcctttatgttgttatcatagaaaagttacacactacctatcccaaaaaaaaaaaagtatgcaaggaagataatacttagttcttgcaacttgcaaatcaccatttacgactttgataagatatcaagtttcattaaaaagaaaagcatcaattccagcagaaaagcaagttcatttttttcctgttatgtgctagagtatattttttgagccctaaaaaaggatgataatcatacctcagtgttgctgcattgcatcacggcacatcctacagaaccccaatactcctaccatgttaaaaagacaggttaatccataaataattttaaaacagatatgaagtgtatctacaccgagtggcaaggttaaaaagattaaggaggggaagttgcttgaattcattagccatctacagaattgaactttctattatgaataaaagttttaccttatcaaaataaaaataaaaattgaatggcttattgaaaaaaatgttgttgtttttttttttgcatagcttcttgcttgtggtaggattaatgctaagacttaaaacttgttgacttggtacaatcttgaaatactaaagatcaattttttagcaacaaataaactttgtccaagaaaaatgaatgaagcttctctacattagttattcaatgtatattttgctcaagaaaggaaattgtaacacaattacacaaccccattaagtagaaaaatacctggagcctttgaatggcttgttggaaagttggaacagatggtttcttttgatgttctgtattgtgagacacagaagaagtagaagaagaagaagtggagagtgcagagacagtggaagatttagagagaaaacgcctgtgaaaaatgataggaagaggcttagtggtggttaggagaaaggagaagtgagtcttgtgaggtttgagaatggaagtgactaatgggagtgcaagaatcgccattgcgaaacctcacaagtttctgctttctgaattctgggtggggtttatcctagactagagtggcgataaagagattacagaaagcaggacattttcattccattcctataaatacacaaattagcaatcacttacccttatggactcggggaagggttgagattagttatagaatgtttggccaagcatctggataggccaaaattttattttattttaaaaagcacttcttttttttcttaacttaagttatttggtcaaattttttttagggaaaaatacttttggaaagaagcagaagctctttatgagaagcaaaaaaaggtagctttttctcaaaagcagaactagttttgacttttctttttatcaaaaatatccttaacaaaatttagtatataccaaaataaccgttaaatctaatacttaggatataactaaggacgatgatggaaactatcccagaaaggtgagcaagaagagtcttcacttctcctactccactactttcctcattcaaggcgtgattaatgcgccttaaacctctctcttaaaaaagagcattttttagtagagccttagcacgtgaacccataggaacagggcccttcttctttacaacctaggtattcaaaaggagggttattacataaaaaaatcacataagtgattagagcgatgcccccttgctttggaaagagttgacttcttcctctaatatatagcaactttaggggtgaatgtttttatatttgttgaatatttttaatatatttaacttatattaaaagaattaagtaatttttaattttattgtcatattttacttaaataaaatgaaaacatttaattattgcatgtaataacaaatttttgagattatttatttacttataatattaactattaagtaaatctattcatatctttattcgtaatttgatacttaaaagcactttcttaaaagcttggtcaaacacaaattattgctcaaaatttttttccatagtaattagccaaacacaaaattcttctctcaaaaagtacttttttcaaaagcacttttaaaaaagtacttttttcaaaagcacttttaaaaaaaatacttctcaaaataagttgatttctccaccttggccaaacaggctattaatgttaagcaatcactttccctttgggactcggagaagtttaaaatttgagttaagttaaatgttaggaatttttacatcatatagcaaaggttgataccttatttattttaaataaataccgttttaaaaaattatattccatagctaccttttgatttttatagccaaatatctatttatggtcacctcatactcttaagccataaaatacaccttgtattatttttctctctcattctttcagatttttctccaccctatctctcttaactccggtctttctccatgaatacaaccacaattctcccaaatacagatcgaaacgggcagctttgactctcaatctggaatacattcagggtgtaaaacgtgatcacactttgggatcaaatgcagcatttcgtcatcttcaaactcgttcaaacatacagtgcattcttgttacgacccgcaatattacgtcgatattacgtcccgcagtattatattacgatgatgttacgtcctgcaatattatagtacgatgatgccacgccttgcagtattacattacgatgatgttacgcttcgcagtattaaattacgacgatgttgcaccctgtagtattgtacgttgaaggattatgatatttcacaagtgatgagtaaattcgtgaagataaaaggggaagcaagtcaaaaaataaattttcgttcaagtttggcatgttgggataaaatacgggctgagcgttaatacccgatatttatggactagtaccatacaaggtagcatatgaccatgatcgtatgatgtataaaatatattaaaaatgagtaatattttaagtaattttgagataattcttaattatgtgggtaattggttaattatctgtaactacccggccggtcattttaggaattaacgccctgatcacctattaactactttccccgtatttgtttctgctatttggacttgtcgggatgtttggttttgagtttcggagagttttgggacacttagtccctaaatgagggtttaagttctagaaattggaccgtagtcggagcagtgtgaagacggcctcataatggaattatgttggttccgttagctccgttgagtgatttggggcttaggggtgtgatcagattgtgttttggaggtccgtagctaatttaggcttgaaataccgaaagttgaatttttgaagtttccggttcgaaagtgagattttgatccgagtgtcggaatggaattccggaagttggactagctcagtagtatcgaatgtgacgtgtgtgcaaaatttcaggttcattcagaaaaggtttgatatttgatcgaaagcataatttatgagtttttgaagttcttaggcttgaatccgatgttaaattggtgttttgatgttgttttgagcgttccaaaagttggaacaagtttgaatgttgttctaggattggttggcatatttagttgaggtcccaggggccttggatgagtttcgggtgcttaacggaaattgaattagacttagaaagaatttgaattgatgaacctgtcataaccgcacctgcgtgtgtgggaccacaggtgcagcaccgcaaaagcaagtttgggccaaagatccaggaccgcaggtgcggctgggtttcgcaaatgcggtgccgcagataggggtgtgcattcgaaccggtttatcgataatcgaatcgattatttgttatcggtttatcgatttatcgattttgattttgaaatttctcttatcgagttatcgatttcgatttcgattttgtcctcttcggttatcggtttatcgataaaccgataagatatactaaaaagacaaaaagacaaaaaaaattatccttattctataataccctttcctttaccctaaatgcctaactctattatttctactaccacatttaaggaatgatcatatttaaagctcaagggaatgaagttcaaactaatggaaaacagaattagctgtgatgatgtattttgttttgttttttataccgttggagtgttggtggcatacatttgatctcttactttagtttcgttgcatgtgcttgttgacacaatttttatattatcaatggtgtttgtcttattttagcttctttttgtccatattagttaggcgtgtttatagcgatatactttccgtggaattccgtaaattttcttattggtgtaatcgataaccgaatcgataagccgcaaaaatcgataaatcaaaaccttatttaaacgataatgataagcatatgtacaaatcgataatcgataaataattattgataagggtcaaaatcgaaacgataaatcgaatgcacacccctagccgcagatgcggccaagcgaccacagaagcggacccagtccgttaagtgattttcgcacatgcaatgccttcttgcgcaagtatgggaccacaggtgcgctcccttgaccgcagatgcggtaatcgctgggcagaaatataaaatttcgagggtttcgttcaaaacttggaaaaatcaaattggagctcgggagagggcgattttgggaggaatttgaagaggaaatcattgggtaataattccttaatcctttctagttgtattccattaatctattgttagttttgtcatttaatttcggattggaggtgaaaattggggggaaattgaaagagagttcttagacctcaaattcgaattttgattgagaatttgaccttggatttggataatttgggtatgcatgaactcataagagtatgaggattctgaaaatataaattttacccgattctgagatgtaggcccgaggggcgttttggtcattttacctaatttcgcgtattagcttagaatttatttgtagaattagttacttgaagtgttatttatattatgcaattaaattgaatagattcgggtcatttggagtcgagtactcgtggtaagagcgtggtttcaggttgaatttgagctgtctcgaggtaattggcttgcctaaccttgtgtgggggacattacccttaggatttggtgatgtggtaattgaaatgccttgtacgtgaggtgacgagtgcgtacttgtgctaattgttgaaaaatatgttcttactaaagtagctttaattgtatttttcctttcctacgtactctacttgaaatttatgcctgctgttagcttagaaaagcatgcttaatcgacttaattcttttattaactaccttagttgtattatgtgaagcatgataggttagaattacctgttttatttggtatgaaattgagcttagttgagtattctttgtattgttgctgtgtgttttactttgggactacgagacgacatcccgggagatcccctgcacgtatttataatttgagctgaggtgcgggataccgagatatctctagcacatatattgaggataccaagagatcctagggataccaagagatccctagcatatattgaggataccaagagatccctaacttgtattgaggataccgagagatcctcgggatatcaagagatccttggcatatatttagggtactaagagatcctcgggataccgagagatccctggttattatccttgtgaagagcgatatttccttgtgattgtttttgtctcagttctagttattgtattccttattatcatgtattaaattcttactattagctttcaactgtactgcttatcttattctgtcataccttatattttatttaatctcagtagggccctgactttcctcgtcactacccgaccgagattaggcttggcacttgcagagtaccactatggtgtactcatgccttttctgtgcatatttttcatgtgcagatccaggtacctccactcagacttatcatgcttgagacgaggcattcgtagagactccgaggtatatctacagcgtccgcagacctaagagtccctttctactctcccttttgtattagcccttctgtactttgtgtctttgttagatcttctggagttagatgtttgtagactttcaaaggtttgtgatcatgagattccgggttttgggaaaagttattagctttcgagagttgatattgtatatgccaagtggtactttaaaatactgtttcatttcactacttcgggttttaattttttcttacgcaaattggtttatttcccgcattgttaggcttacctagtcgtagagactaggtgtcgtcacgatggttcacgtagggcgaacctgggtcgtgacaaattggtattagagctctaggttcataggagtcatgaatcataagccggtttattagagtctcgcagatcggtacagagacgtctgtacttatctgtgagaggctatgtaactgttaggaaaaatttccatttcatttgatttccttgtcatgcgagattttgatatcacaaatctaaacttctatcttctattctctcacagatggtgaggacgcgtgctacccgagatgatcatgtacccgcgccccctacgacagtcatcagaggctagggccggggtagaggccgaggacgcgcacgtggtgcagccagagcacctgcacgagctgccgccgaggtaccaccagtagttccagccagagtccaggcacctgatacgcctaccgctactactactccagcacttcaggagactctagcacagttcatgagcatgtacaccactttggctcaggcagggttacttccccttgttgcagctacatcctaggccgggggaggaacacagactcccgccgcccgcactcctgagcagcgagtgcatatggatcaggttcgagagattattccagtatcgcctgcagccccaggtcagcctgaggacagggcagcggttttagaggatgagcagcggaggcttcagaggttaaggaagtatgatcctcctgtatttagtgggttagcttcatatgacgccctgggatttctggaggagtgtcactgtatcctccacactatgggtatatcaagatcgagcggggtttctttcactgccttccagcttcgaggagccgcctatgagtggtggcgcacctatgagttagacagtccggatgaggcagcttcactaacttggactcggttttcagatatgttcctgaaagagtttgttcctcagagcctcagggatgcatgtcacgcagaatttgagtatttgcgccagggtgttatgaatgtcttggagtatgctgtccattataccagtttggctagacatgccccagccttggtttctactgttcgcgagagggttcgctggtttattgaggggcttattcccaacatcaagtctagcatggctcgtgagttggaaatagatatttcttatcagcaggtggtgagcattgctaggaggattgagggtatgcatgctagggaaagagagaggagagggaggccaagaggtctcgagagttgagctattattctggtgcccgtgccccagctacaggtcgtcatggtaggggttatatgagtcgccatgttcattcatctcttccagcagccagtggtattccagctcctcctaggcctcaagagccttattatgcaccttgagtttctagcgtgcttcctgcgggagtgctttcagaggtcagtctagcagacctggatcaagctagtcacagccgtcacgtcctcccagagcttgttttgagtgtggtgacacactccatgtggtgagggattgccctagacttgggaggagtgcgcctccacaaacttctcagccacagcgtaccccgtagagtactcaagctatggttacagcttcagttgctaccccacctgctcagctagctagaggtggaggtcggggaggtagaggtcgtcctagagggggagaccaagcccaatactatgaccttcctgcccataccgaggttgttgcctctgattctgtcatcacaagtatcgtactggtttgtcacaaagatgcatcggttctattagatccgggctccacttattcttatatgtcttcttattttgctccacatttgggtatacctcgggattctttgagttcccctatttatgtttctacccctgtgggagattctcttattgtggaccacatttatcagtcgtgtttggttgctcttagtggtttgagaccagagtcgatttattgttactcagcatggttgattttaatattatcttgggcatggactggttgtcaccccactatgttattcttgattgtcatgccaaaaccgtaatgctggctatgctaggtgtatcgcgtgtggagtggaggggtgatttagatcacactctcagtagagttatttctttccttaaggctcaacgtacggttgaggaaggggtgtggcgcgtatctagcttatgtgagagatgtcagtattgataccacttccgttgattcagtactagtagtatgggatttttttgatgtgtttccatctgaccttttgggcatgccgcccgatagagatattaattttggcattgatttgttgttgggcactcagaccatttctattcctccatatcgtatggctcctcctgagttgaaaaagttgaaggatcagttacaggaattgcttgataagggttttattcatcccaatgtatcaccttggggtgctcatgtcttttttgtgaagaaaaaggatggttctatgcgtatgtgcattgattatcgccagttgaacaaagttacggcgaagaaccgttatcctttgtctcgtattgacgatttgtttgaccagcttcagggcgcacaagtgttttctaaggttgacttgcgctcaggttaccatcagttgaagattcgggagccagatatcccgaagactactttcaggacttggtatggtcattacgagttccttgttatgccttttgggctgaccaatgccccaacaaactttatgcatttgatgcacagtgcgttccgaccatatcttgattcattcatcattgtctttattgatgatatccttgtatactcccggagtcgggaagatcatgagcaacacctaaggacaatgcttcagacattgagggaaaagaagttatatgcaaagttctcaaaatgtgagttttggttggattctgtggctttcgtgggtcacatagtatcgagtgagggtatacaggtggatccgaagaaagtggaagcagtgcagaattggcccagaccatcctcagcgatagagatccgtagttttcttggcttggcaggctattaccgttgatttgttgaggggttttcatctattgcagcacctatgaccaggctgacccaaaagagtgctccattttagtggacgaaagagtgtaaggcaagttttcagaagctcaagacagctttgactatagccccagttttgatattgcctataggttcagggtcttatactttttattgtgatgcctcgaggattggccttggagcggtattgatgcaggacggtagggtgattgcttacgcgcccaggtagttgaaggtacatgagaagaattatcatgtccatgatctcgagttagctgccattgttcacgccttgatgatctggcgtcattatttgtacggtgttccttgtgagatttatactaatcattggagcttgcagcacctgttcaatcaagaggatctaaatttgtgccagagaaggtggatagagttgctgaaggactatgatatcattattttgtatcaaccgggcaagaccaatgtggtggctgatgctttgagtcgtcgggaagagagtttgaagagtttagcttatttaccagcattggagaggcccatggcgatggatgttcaggccttagccaaccagtttgtgagattggatctttcagagcccagtcaggttctagcttgcgtggtttctcggtcttccttatttgatcgtatcagggagagtcagtatgatgactctcatttgcttgtcctcaaggacaaggttcagcatggttatgctagagatgtgactattggtgatgactgggtattgaggatactgggtcagatttgtgtacccaaaattgatgggattcgggagttgattctagaggaggcacatagttcatggtattccattcatccgagtgtcgcgaagatgtatcaggatttgaggcaacactattggtgtaggcagatgatgaaagatatagttggatttgtagctcgatgcctcaattgtcagcaagtgaagtatgagcaccagagaccgggagggttgcttcagcagatagagatttcggagtggaagtgggagaaaatcaccatggacttcgtagttggactcccacggactttgaagaagttcgactccatttgggtgattatggatcagctgaccaggtctgcgcatttcattactatgtgtactacttattcttaaaagcggttggcagatatttatatccgggagattgttcgtctgcatggtattctagtttccatcatttcggatagaggtactcagttcacatcacggttttagagggccgttcagcatgagttgggtactcgggtggagttgagtacaacatttcaccctcaaacggatggacagtccgagtgcactactcagattcttgaggatatgctctgtgcgtgtgtgattgagtttggagggtcatgggatcagttcttgccattggcagagttttcctacaacgacaactatcagtccaacattcagatggcgccgtataaggctttatatggtaggcggtgtagatccctggtgggttggtttgagccgggtgaggccagattattgggcacagacttggttcaggatactttggagaaggttaaggtgattcaggatagacttcgtacaacccagtccagatagaagagttacgcgaaccggaaggttcgtgatgtttcctatatggttggagagcgggttctgcttcgggtttcgcctatgaagagcgttatgagatttgggaagaaagggaagttgagtccgaggtttattggtcctttcgagatattgagacgtgttggggaggttgcttatgagcttgccttacctcctagcttggcaggggttcatccggtatttcatattttgattctccgtaagtatcacggtgacccgtcgcacgtgttagatttcagttcagtccagttggacaaagatctatcttatgtcgaggagctagtagcgatattggacaggcaggttcgaaagctgaggtcaaagaacattgcgtcagtaaaggttcagtggtgggtcagccggttgaggaggcgacctgggagaccgagcaggatatgcgcagccattaccctcattttttcactacttcaagtatgtctctacgctcgttcgaggacgaacgaatgtttaagtatgggaggatgtgatgacctggccggtcgttttaagaattaataccctgatcccttattaactgctttccccatatttgtttctgctattttgacttgccgggatgtttggttttgagtttcggagagttttgggacacttagtccctaaatgagagtttaagttctaaaaattggacagtagtcggagcaagtgtgaagacggcctcgaaatggaattttgttggttctgttagctccattgagtgatttcgagcttaggggcatgatcggattgtgttttggaggtccgtagctaatttaggcttgaaatgccgaaagttgaatttttgaagttttcggttcgatagtgagattttgatccgagggtcgaaatggaatgccggaagttggagtagctctgtagtgtcaaatgtgacgtgtgtgcaaaattttaggtcattcggacgaggtttgatagactttttgatcgaaggcgtaatttgtgagttttcgaagttcttaggcttgaatccgatgttacattggtgttttgatgtttttttgagagttccgaaggttggaacaagtttgaatgatgttttaggattggttgtcatgtttggttgaggtccccggggcctcggatgagttttgggtgcttaacggaaattgaattggacttaggaagaatttgaattgctaaacctgtcataaccgcacctgcatgtgtgggaccacaggcgcggcactgcagaagcggctaggtggctgtagaagcgagtttgggccaaagctccaagaccacaggtgcggctgggtttttgcaaatgcggtgccgcagatgcggccaagcgacctcagaagcggacccagcccgttaagtgatttttgcacctgcgatgccttcttccgcaggtgtgggaccgcaggtacgctcccttgaccgtagatgcggtaatcgctgggcagaaatataaaatttcaagggtttggttcaaaacttggaaaaatcaaattgaagctcgggagagggcgattttaggaggaatttgaagaggaaatcattggttaacaattccttaatcctttctaattgtattccattaatctattattagttttgtcatttaatttcggattggagttgaaaattgaggaaaaattggaagaaagttcttagacctagaattcgaattttgattgggaaattgacattgatttggataattttggtatgaatgaactcatgagagtatgaggattttgaaaatataaattttacccgattcctagacataggccctaggggtgttttggtcattttacctaatttcacgtattagcttagaatttatttgtagaatcaattacttgaagtgttatttacattatgcaattgaattgaatagatttggtgcatttagagtcaagtactcctggcaagagcgcggtttcgggttgaatttgagctggttcgagataagtagcttgcctaaccttgtgtgtgggggacattccccttaggatttggtaatgtggtaaatgaaatgccttgtacgtgaggtgatgagtgcgtacttgtgctaattgttgaaaaacatgttttcactaaagtagctttaattgtgtttttcctttcctacttactctacttgaaatttaagcttgttgttagcttagaaaagcatgtttaatcgacttaattgatttattgcttaaattgccttagttgtattatgtgaagcatgataggttagaattacctattttacttgttacgaaattgagcttagttgagtattctttgtgttgttgctgtgtgttttactttgggactacgggacggcatcccgggagatcccgtgcacatatttatgatttgagctgaggtgcgggataccgagagatccctagcacatatattgaagataccaagagatcctcgggataccaagagatccctagcttatattgaggataccgagagatcctcgggataccaagagatccctagcttatattgagcataccgagagatccctagcttatattaaggataccgagagatcctcgggataccaagagatccctagcttgtattgaggatactgagagatcatcgggataccaagagatccctagcttatattaaggataccgagagatccccggttattatccttgtgaagagtggtatttccttgtgattgtttttgtcttagttccagttattgtattccttattatcctgtattaaattcttactattagctttcagctatactgcttatcttattctgtcataccttatattttatttaatcttagtaggaccctgaccttcctcgtcactacccgaccgaggttaggcttgacacttactgagtaccgctgtggtatacccatgccctttctgtacatgtttttcttgtgcagatctaagtacctccactcagacttatcacgcttgagacgaggcgtatgtagagactccgaggtatatctgccgcgctcgcagactgaagagtccctttctactctcccttttgtattagcccttctgtactttgtgtctttgttagatcttcatgagttagatgtttatagactttcaaaggcttgtgatcatgagattccgggttttgggaaaagttattagctttcgagagttgatattgtgtatgctaagtggcactttaaaatactgttttatttcactacttcgggttttaattatttcttccacaaattggtttatttcccgcattgttaggcttacctagtcgtagatactaggtgccgtcacaatggttcacggagggcgaaccggggtcgtgacattatcggataatgggacatcacctaattaattaattagttataagataagatttaaacaatcccccacccccacgtggctgcaagccgctactaagacatatgactcttaatcatattgtcttaagtggccatcttaagtaaggcacataaagccacatacatataagacttattcaagtttggtttcatttatacaaagttcggtttcatttggtttcatttgatttcatttatacaatctttcttcctaattcaaatgctctaaaaacagacacaaaaacttggcttcatttgattttatgtatgcaacttttcttcctaattcaaaacctctcaacaacatacgctaaaacccaaatccaacaaccttccaacaaaatttcttgcgagcaaatcaattccagcgagaaataattagcaccttagcaacgtaaaattttacggttctaaaggagtacggtgtaaccttttccaagaatatcgtacggattttcccctactccaggtatgttaaggctatccttctttctttttacctatgcatgacataacattcatacgcatatgcgtgacactataattatttcatgaattacagagttatccagacttacaggctgatcatttactctatatttcttccatgtctgttatgtacttatttatgtgccttacatactcggtacattattcatactaacgtccctttttgcctggagacattgcgtttcatgcccgcaaggccctatagacaggtcgagagccctccaagtaggctatcagctcagtggaagatgctggtgcgcttcatttgcttcggagttgcttgtttggttagtatgacttagacatgtattgtttggtatggtgggactctgtcccgacctttatgaaaattatgtattcttagaggcttgtagacagatgtcaggtacgtaaatattgtatggccttgtcggcctatgttcagtgtacgggtagttattttggccttataggctcgtatgtcttatgtataggttggtatcacatgttgtattctacttatctcacggcagccttccggctcagttatctatgatagtatgacaagaaaagatacgttatgttggtactcggttgagtaaggtatctggtacctatcacgacccgtcggtttgggtcatgacaaaagtggtatcagagcagttctgtcctatggagtttacaagctgtgtctagtagagtcttgtttatgggtgtgtcatgcaccacacttataagtagggggctactaggcatttaggactgccactctttcttcttactctagatcgtgtggtagagctcaattgtaaggaatcaatttcctaaactctatcttatttgtaatacaacgatgtctacattcagaaagacggtcggtaagagatatagttgtggaagtgttgagttagaggaactcgattttgcatcatgcttatgatgagtaaatgtgaggtcttcaacagaccatgcgtgtactaaaaggtgtaagattcttgataaggagttttaaggcaagaatacttatccactcttacgttaaaaaggaataacggaatcggaaggtagacacaagtttcaacaagtaaaagaagcaaggttaagaagggtacgaggtgcccagttaataaagattatcattatttactattcaggaagggagatataagcattttgagttaccttcaacagtaacagatgtatgtacaatcggccacactgatctcagttatgccctatgggatctgacatatatagtttaagagaaagacgggttatcaggatctggctggggttaaagtaacccaaaatagtggatggattggtagagttagttgacatttctgaaggatagtgcaaacatgataatggatctccttgtgagacaactagacggtgcactctaaaatagtacaactagatatgactactataaagataggcattggaagcctagaaaggataaatattatcttagtataactcccgtccctagtagagagataattctaggcaacccgaagagctagtagatggaacaaaggggagctaaaagcaaaagaatatcttgttgaagttttcagaataaagtgatagacagaaatattagcaagaaataagaaaagagctaatgaagcattaagagtaagatgtgatgcattgatgacaatggtaggtcagaaagatgacagtattacagagactatagtcaagtaaaggaaaaatcgagaggtgacaggccttaagacaacaaaatagtataggccataaagtcatatgctcatttcgagaaataagtttgcaacgctgacgcgattaccaaaaggaaagttagacccccacaataatagaaactagtatggattggtgaacaggataagctaaacatgaattagggattgagtgatttgataatagtcggcatcatgacaatttcagatttcgttctggcaataatagaatggacaacagaagaagatccatgatgaattaagagaatgctaattcaaggagacgcttccctagagcaagcaatatgagcaaagttaagcttaagggactatatgtgccagttacactaagtgtcactatcgcgagtgaggaattttgttatccttggtacaaaaggattaccgcaaggcgagtaagggttattgatgatgtgaaaggacgctagagatgaagaggaaaaacatctataggcaggtcgtcatagctccaagtcttagtactcccctaaaagggggaatatggaatgataaaggaagaatgcgataaaaatgagaaagagatgagattgaacctatccagatattatagatatgatatgattccagaatgttatgtaagcacggcatcaaaaaaaagtaaaagttcatgcccgagatgttattgatagataaggagctagtacacgaggtaagttaagataaggaaataacccaagaaagattacgctgaatatggatatgagaatgggacgacgagtagttagtagttgattcaggaagagactagtcatgactagacaagaagttacagacaaattagcagatcatgcaaaataaatatagtaagccccaacatggagaattcagcctcgtagtaatatcattataatacttgagatatattcaaatatgagtcgggatagttaaaggtaccgtatgagtgttacgggaataaaagaaagtgccgctgggaaggcagtaaaaatattagttcagaagcaaccctacaagcacaagggcacggaggtaagcaacttcggacgattatagacaaggaaggacatcaaaaggtctgtaataagctcacaactttatgagagtcaagggttctccctaagtactacaattaaacactagctgagtaaataaggaagaaagcttcaaccaaagcacaatgacctaaaaaggaaagggttgtgtaacaacaatctaactaaaaaattgtatgcactccaaagcacctatcatggctaatgagtggagagtaaaaaccaaaagtaatattcaagaccatatgagttgcacaaaaacttcgacatgcgtgagaactcagataagctaagtatgcacgcaaaaaaggggcaaaaagaccaggaaaagcaattgcttacatttcgaagaaagctgaaatagaatgaaaggaattattcgattaatgatcagccgtagaagactctggtatgagctaaaagaaggaattgggtccaggtcatagacaaatgattgaatcattagaagattatatcatggttttccatagcgtccataaaaggctaaagtaatacctaaatgtcatgagccatagatcggaagatagcttgagcctacataaaggttaatcagaagaaagaggaaactaaagagttacatcaactaagtaaattaggagactgcatattggacccagaaagttacaaacatcatgattgagaatattgtaaaatcactcataatatctgaggtacaagagaaatagtacagtagccatattctataagagctctacgataaagccagttagaagactaccagtatggagctaccaccagattgtgtatgcactagaggtgcaaatattataagagagcttcaagttgtggatgtgattatacctatgtggaagggagttcatgaaagagataaaagttattatgtgagactttaagataagtaaggtaaggtggacaacgtactagattctcaaatacagaaggttgtgaatagtccttacttctgatagaaggctagaagtgcggggattcaatatctaggaataatagcggcatcgtcagtagcatatcctccagcctattgtctaggtatttagaagcctgattaagagagtaaagaagagtcataaacgatgcgatgtcttgcttgatattccagagggacataaggaaatctatgatacaaccaagttgaaaggctgcaagttatataaatagatatgtgtaggtcacaagctattgtatggtgaagcaacaaggttgtagaaaacaggagtaaggataagaaagggcgagtgagaaggtaatgaaaatggataagtcatcaggattaagcccatgaaaacaaaaaaggtagatggtttctctaagttatacaaaactcactatatcctaaatgagctcaaaggagtctaagactaatagcatttagaagagatataatgttgccctagtagtagaataagggtgtgattgtgatagataaagaactacgtttgggccttcgattgagtaatggtctgacgaagaaaagaaaggggttccatgaattagacaagattaaaatagccacataaggtgagtcacattgggatgctatgaaatccaattatggaagtatagtatcgtaccacccaggtggatcaaaaaaatcacttcaaatgttccacgatgcaagatgagcccaagtgattacgtaagaggttccaagttatcagtggtatattgtagatcaatattgaggtgaatcaacaatagatgggcccaagtcacaaagtgtgaggtgagattaggccgtcattcttaagataaacaagtaatgaggaagcactaaatgacctagatatatacatacgagataagtaacgaaagtaacatgtagttcggtagcagacctcagtaatgataaagtcatacggatggataaccagatctatgaaataagatatggctgtgagcacctaatttttgccctgcatgaaaataactcctaagaaatagaccaaaaataattttaatggattttaggagtttttctttatttagttgcatttttaatattttaaaaccatagaaaaaatgataaaaaatgtcatgttttaatttcatgtcatcttaggtccaatttgcatgtaggcattaattttattaagaaaaatctttaaaaattgtcatttttacatatttagcttttagtctttagaaaatagtgtttttatttagttctaagttaattagttattttaatagatacacaattttaatttttacaaattagattgatttaggattaatttaggattttattagattttaaaatcaaagaaaaagaaaaatgaaaaaaagattttgatttagtcttcctaccccaaagttaattagcctaaattcatgacccaaattccttcaagcccaaaacattgagcccatacccatttcccatttgacctaacctaatttcgacccctataaaataatgctaactcctaaaatcaaggggatagacctaagacttagagctaacctaaattcctaattctaagaagacatcacccggattccacaccaagacaaaacactgccaccgcccttattttcctaaaaagtttcaatttctactcaaacaaacaaacaaaattgaaaaacaattcctacataatcaacgtccaatttgtgccagcggggattttcttgtttccctttcagaaccccaccccaaccattgttaaacccattaaaaatatacacactcacaaacgcatatgggatagaagatgggatcagcttcaataaattacaagataaaaaaatccagcaaactttgccctattgctccacctgaaaccaccagtttccgagcccaaaatgcagccaaagggagcatcaaaactagatctaaaacctctaaattccagcccgaaatcacccccaaaacacccccaaattccagctcaaaaacgaccccaacaaagcccatagctgctgcaaaatcagccatgaaacaaccttgaaactagctgcttttccttcacgaaacctaacgaattctaaccaaaacagaatagatcgagtgaagctttctgttaagcctggttttcgattttcgagagcttcgtctgagtttttcggcgaggttttctggcaagtttcttgtttcaatctaagttgtagacgtgtgggattattgttgctgtgttgcggctttgctgagctccgtagctgattttattgcttcttcagttaagccttcatttggggaccgatagtactgccctcttttctcaagctaggtaagttcatgtaatttttattttatttttttagtaatgaaatccttgatttggtctttgattttgctgaggaattctgttaatcaacccatttgatgcttgtgtgataatgtggaaagtattcagatctcacctattgtttgttagaaaacttttgacttagtctaagcttcagaagcactgacagtagtcatgctttggattaatccatattaaaaccatgtagttgatttagatttataaatttgaagtttattttattttatttttttaattttgtcgtaatgtgtaatgggctaaagttgcaaagcaacccaacaaagtgggtcaggaaagcttgtttggaattttgtggtaattatagcatctttggtgaatcaagtttgtttttgttaaaactcgctagatcacttgaattattgtttaattttttgttaattgagactagctttcttttatttattagttcaaggttgtgattttcatggatagattatgtgaataaaatattagtaataaatttatttgtaatatatttgattatactaacatttagtagtcaaagccacactttctttaccatacttacctgtgtcccaagaactcaataatctcaaagtagtcttagaaagaataattcattgaacatcgtagcttgctttaggcgcgattaaaaaaatcatcatagctacgggtacagtttcccgtaacgtagttgtgatacctaatttccaaattcgggggtacatctatgtgacccggccacaacttctaataactttaagaaattaaacatgttgtagatcgtgggtacgagctcccgtgatatagttcacaatatgtatcaatcctaaacccttcacccctatgttctttccaatcctaaaccctttccaattccaagtattaattcccagagcttcatccacctcctcaacatccccgtatcccatcttctcacatattttctccgccgtcttatcaaacaccgccgccacattcaccgttgttttagtagaagcttcaataaacaaacatctattactcttcgcgaattcctcgccttcctctgcactaacagtcataatattttctccggcgtcacactcacttattccccaccactattactgtcgtgtcgcgttgttgcaatatatcttcaagccaactcgacaaccgctcgaaagtgtgccttttagtcacatcgtaaacaagcaaagctcctgcggcatctctgtaatatgccctcgtaaccaaaaggtgtagaaggaaagcaatttcaaattagcgaagctcccgcgacgtctttgtaaacaagcaaagctccttctaaaaggtgtaggaggaataataaaagaaataaaataagaaggaaattttaaataaattaattataaaaaaagacccctgatgacacgtgtaaaataataaatggctttagtatttgacgtggtatttttgtcaggcaactaagctacacgctctgaagaaggggtttatttataatcaactggttgagttgaggtgctaaaatgggaaagtcaaaagtttatatatcggctttaaaattcggtacaagtttaagtggctaggaggccatttcgccttcatttattagttcaaggttgtgattttcatggataggttatgtgaataaaatattagtaatgaattcatttgtaatatatttgattatactaacatttagtagtcaaagccacactttctttaccatacttacctgtgtcccaagaactcaatagtctcaaagtagtcttagaaagaataattcattgaacatcgtagcttgctttaggcgcgattaaaaaaatcatcatagctgcgggtatagtttcccgtaacgtagttgtgctacttaatttccaaattcggcatgtgtcctacatggttggtgagaaagttctattgaaggtttcacccattaagggtattatgaggtttaggaagaagggtaaattgagtcttcggttcattgggccttttgaggtgctttggaggattggggaggtggcttatgagcttgctttgccacccagcttgttgagtgtgcatccggtatttcatgtttctatgcttcagaagtatattggggattcgtcttatgttttggatttcagcacggttcaattggatggtgacttgacttatgatgtggagccaacaactattttggagtgtcaggtttgaaagttgagatcaaaggatatagcttcagtgaaagtgcagtggagaggtcggcttgtggagaaggctacctgggagaccaagcgggagatgcagagcagatatcctcacctgtttgaggcttcagatatgtttcttgacttgttcgaggacgaacgtttgtttaagaggggaaggatatgacgacccggacagtcgtctcatgagttactgctctgtttcccctatttttgcttcttattactttgtttatcgattttatatatgatcgggttggatggatcgggttcagaaaagttttggtaagatttgagacacttagtctcttttaggaagcttaagttggagaagtcaaccggatgttgacttaagtgttagagggttcagaggtgagttccgatggttcggatatctttgggaggtgatttgggacttaggagtgtgatcagaatgtattttggaggtccagagtaagtttaggcttgaattggcgaaattaaatttttggcgttttccggttgatggatgagattttgatataggggtcggaatggaattctaagagttgcagtagttccgttgtgtcatttgggaagtgtgtgcaaaatttcaggtcattcggacgtggtttggttggtattttatcaaaagcgtaatttagaagattttggaattcttaggcttcaatctgatgcgaatttggtgttttgatgttgttttgagcgttctgaaggttagaaaaagtttgaatgatgttatgggatatgttggcatatttggttgaggtcccggggggccacagatgagtttcgaatggtcaatcggaccatctcatgttttggaaaagtgcagaaaactgatgttcagtgttgtagagaaatgaccttcacgttcgcgagtaggccctctgataataggctatatatttgttatttacaccataattgcccatgctttgttgttggtttataatgtaagttgccaataaaatgctttaattaatgctatttggtttcgcagggaatataagatgtgaggaagcaacatgaagtgtttagaggcaataacgtgaagaaaacactcactcaagaagtacccaaatacaaaagagcaaaaagagaaggaacgcgaagacaaaaaggcccagcacacacaccgcggttgccaccgcggtccgcatcgtggttggaggcagtgttctctgcggtcagcgccgcggtcaacgccggggccacgacggcaggttcacagtccagaaagttaaggggccaaagtgtcaattcgaggaaacttttgtaaaacccttataagatgtaggaaactcacccaagagaggagagagcttattttgagataattttggcaagaagaacaagtgtgagagatcacccaaaacatcatagttcttattctcttctatttttcttgcaattttccattatgaatattttcgtagtttattcttacgttgtcatgagtagctaaatactctaatctaaggttttggtgaaacccgttggggatgacttggttgttatattaatatagtttgaattggttgttaatctctatttgttcatctacgttttgattgtggttagttgaaagtgccctcaattatccgttcctatttattatgtatcttcttgagaaagagtgcatatttaggtagttgtttgaacaacatcactcccggagtatagacgagagtcataaccgagggtttagagattggattagagataacgatacctcgggtgcaatttaaaataacggtaatgtgaatctagctagcgtagcttgagagagtgcatctagtaaattatcataattgcttgagagagatttatgatagccggagagttcttgattgatagagacaactaaggcatcgctataagaaatgtacaaccaaggaaatcaccaacgggggaaaccattaccttagaccttattccatttgtttacacatcaagcatagttaattttcagttgttaattattttcagactttagttgttagaaatatcatcaattgtgaattacaaagtttggggaaaattgattctatgaatttagtaaatcagtcaaaagtaattgataggttaattctctgtggttcgaatctgggcagaattactcagattatatttgctacgtccgtgtgtgcctttgtataaggcatagtttggcgttatcaaattttggcgtcgttgccgggtacttaacggtgttatcaattacaattaagagatgtacaaaaattctaagtgtagtcagttttctctatacccaatcttttcattgaaattctaacgtttgaactcttatggaaagcaggtgtatgcctagaagttcttcgaggattggagaactgctagaagggctctcagaccctgagaaaacattcagggcattgaaccgtgccaacaaaagacttcaacaatctcatcaatcacaccaactcgaatttgacatgggtgacatagataacgtcaacggaaacgtcaagaatgagccaactaacttaaatgtcagaagagtggcacctcttgtgcccgaagctgcactttatgactgggcacaacccacaactgataatctggccactgtcatagctgtgcccgcaattcaagcggagacattccagatcaccaacaacatgttgcatctgctgcagaataaaggactgttctccgggtcacacattgaagacccgcaacaacacttgaagaattttttgtcaatttgtatgacccaaagtcagccaaatgcaactccggaagctatcaagctgctactatttccattcttggtaaccagggaagctcagacttggctaaattcgctccctatcaactctattaccacatgggaggaattagtcaagcagttcctgaacaagttctatctgcctaacaagactgcaaaatagattgataacatattgcagtataggcagcaggcctctgagtccttgcaagaaacttgggaaaggtttaaagggatgttagtgaagtgtcctcgccatggcattctagaccagatgctcggccagagattctacatggggctagctgacaatttgaaagcaaatgtggatgtgtcagttggaggtgcatttttaagtaaaacattcactgagtgcaaaatctttctcgataagatgccacaaaattcggggtggatgactagaggtacaacactggcacccatagtgcattcagttcctcttgacccaaataatttgcatgcatagaacatggccacactcatgacccagatgagcatattgacaaagaagattgatgatatgggtacaaaacaggtgcacattgttgatacaacaaatgagggactgtgtacacctcgtataatcagtcttatgtgtgttcatgaagcagagaaggtgaaaatcaatgggcaagggaagatatgaattatgtcaataactatgggggtcagaggcaaggagcatagcagtggagaccgcagcaaaatcagcagtacaagcctaatatgtagcagcctgggggtatgcaccctcaaaaccaattggtgccagtaccatatcagaaaccacagggctatccacagcaaaatcagcaacaattgacataccaaccaccccctcagcagcaagataacaacatggtggaaattaggggtatgcttcagcaactcattgggacaaataataaagtgcagaaaaaattggcagtgcatgattcagccataaagaatattgaaacgtagctgggtcagctgtccatggctttgaacaaccgtcctcagggaactttgactgcaaacacaaatataaaccccaaggaccaaaacccgaatcagctgatggtagtaagtctctggaatgggagagatttagacagagagcaggaaattgcacaagccagcaaagacactacaccagccactccagttcaattagaggtagaggaaccaacagaacttactgaagtggtggttgagcagagtcaggaggaaaaagtcaaagaaaagatgaatgagcaagttgcagaacaggtggcacctcttgtgcctgaaattctaatagagagaatccaacaagcaatgcacaaagggtgatacctacacccttccctcagagactggtcaaacaaaagaaggcataccaatataagaagttcatggagatgttgtgtcaaattcagttgaatattcctttgatggatgccttgagggagatgcccggttatgctaagatgatgaaagatctaatgtcacagaagtttgattttcaggatctatccactgtaactttgacacaaacctgttgcgcagtggtgacaaaactgatggctcaaaagatgtcaaacccgggtagcttcactattccatgcacaattggaagttatgcctttgcaaaggcgttgtgtgatttgggagccagcatatatctgatgccactggctgtgtacaccaaactgggcattggtagagctaggccaacttcgatgctgctacagctggttgaccgcacaatgaagaggcccactggtattcttgatgatgtgttggtacaagtggggaaattcgtgttccatgcagactttgttatcctggattgtcaggtggataaggagataccccttattttagggagaccatttttagccacggggagagcactgattgactgtgaaactggggaactaaaaatgggattgaacgatgaagaagtcatattcaatgttcagcaatctatgaagagacccagtgaatatgctaattgctctctagtggaagcagtggatgtaatcctgcaagaagatgatatgaccctaactgtaaaagatccattggaggcatgtctgatgaatttagaagaaatggatggtgaagggttagctaaatgggtcatggcactggaaggccgaggattttggtcaagggaacctcagttcgagtcccttgagctagaaaaaagggccactcctccagcaaagccattaatagaggaaccacccaagttggaactgaagccactcccagatcacctcaggtatgtattcttaggccctaattcgaccttgcttgttatcatatcatccggtttgttagatgtgcaggtagaacggctcgtacaggtactacagaaaaacaagactgccattggttggaccacggtagacacaaagggtatcagcccagccttctgtatgcataagattctcctggaagaggggcacagaccttccagggaacaccaatgaacgttgaacccaaacatgaaagaagttgtaaagaaagaagtaatcaaatggttagatgcgggaatcatcttccccatctctgatagtaattgggtcagcgctgtccaatatatgccgaaaaaaggggaatgactgttgttaaagatgagaacaatgagttgatctcaacttgtacagtcacagggtggcgtatctgtatggattataggaaattgaacacagccacccggaaggaccatttccccctacctttcattgaccaaatgttggacaggctggttgggcgatcacacttctgtttcttggatggatattcggggtacaatcagatatcaatagccctcgaagatagagagaaaacgtccttcacctgtccgtatggcatctttgcctttcggagaatgccttttgggctttgcaatgcacctacgactttttaacggtacatgttagccatctttacagacacgatggaggatattatggaggtctttatggatgatttctccgtggtgggagattcattcgaacactgtcttcacaacttaagaagagtgtttaaaagatgtgtggagacaaacttagtgctaaactgggagaagtgccattttatggtacaagaaggtatggtcctgggtcattgagtgtccagtaaaagaattgaggtcaaccatgctaaggttgacgtgattgagaagttaccaacgcccacttcagtcaaggcagtgagaagttttcttggacacgctggattctaccggcgtttcataaaagatttttccaaaattgctaacccattatgcaaactccttgaaaaggatcagccctttgtgttttctaatgattgcaggttagcatttgagaaactgaagaagagattgatcattgcacctatcattgttgcacccaactgggagcaaccatttgagctcatgtgtgatgccagcgactatgctataggagcagtcttggggcagcaaaaatataagatgatgcacctgatttactacgcaagcagaatgctaagcggtgcataactcaattacacagtaaaggagaaggagttgttggcggtggtgtttgcgtttgacaagtttcgatcatatctgattggttccaaggtaattgtatacactgaccatgcagcactcaagtacctaattgagaaaaagaagtctaatccacgcctgattcattgggcgctactattgcaagaatttgacctcgaaattcgtgaccgtaagggcacagaaaatcaagtcgctgatcatctatcgcgacttgaaggagctaaaaaatcagtcaaggtcgaagagatcctggaaacctttccagacgagcagctgctcgcagccagtcttgaggaagtgccatggtatgcagattttgcaaactacctgacctgcggtactgttccctatgacctttcatctgtccaaaagaaaaagttttatcgtgattaccgcatgtattattgggacgagccttatttgtttagaatctatgttgataatatgatccggaggtgtgtccccgagatagaacaatcttctgttttgcaggcttgtcacgcatcagcatatgaaggacattttggaggagccaggacagctgcgaaagtgctagaggccgggttcttttggccaacagtgtttagagatgcacacctttgggtgaagggctgcggcgaatgtcagcgaaccgagaacatttcccgtcgccacgagatgcccatgcacccgattcaagaggtagaggtgtttgatgtttgggggattgacttcatgggccccttcgtgagctcatttggcaataaatacatacttgttgctatggattacgtgtctaaatgggtggaagctgcagtgttacccactaatgatgcaagagtggtgaaaggttttgtgaaaaggaatatattcacccgatttgggataccaagagcgatcatcagtgatggagtcactcacttctgtaacagagccttcgagaaattgcttgcaaagtatgatgtatgccataaggtggctaccccttaccatccacaaaccagtgggcaggttgaagtgtccaacagggagataaaaagtgtactaaccaaggcggtgaatgccacacgaactgattgggcaaagaagcttgatgacgcactctaggcctatagaactgcattcaaaacaccaataggaatgtcaccatacaagttggtatttgggaaggccttttacctgcctgtggagctagaacatcgagcttggtgggcactgaaacaattgaacatggattccgaagcagctggacaaaatcgactgacagagttgcatgagctggaagaatttagatatcaagcctttgaaagcatgaggctctacaaggaaataatgaagaagatgcatgataagcacattgtggacagaaatttcaaaccgagtgacaaggtattattgtataattcaaggatgaaattgtttccgggtaagttaaagtcccgatggtcaggaccatttagagtggtgcaaatgttcgcaagtggagctgtcgagattgagtcagaagatgggacaaacaagttctcagtaaatgagcaaatgttgaaacattaccttggaatagctaaagaaaaaagaaatacaatggtaatcaatttgaaagaacccccgtacgcgaatgaggagtgaaggctcaaccacttgcgttgtgccgtgacgttaaatcaggcgttgcgtgggaggcaacccacgaatatgttgtaagtgtagtatgtaactttgtgtaaaaaaacaaaaaaaaacaaaaacaaaaacaaaaatttttgccagtcgcgaccgcagccaggaccgcggaccgcggcgtcgaccgcggaaatcactgagcgattcagtttttcactgcggccgcaggtcggaccgcggcaacgactgcgggagactctgtctcaaaccgtggcgtcgacgtctgctgaattgtaatttttttattttttatttttattttacttttttttcccactcttctttttaattttaaaacccttccctatatcaaaataaacaatcccccctcctaaaataaccacttccctctctctctctctaaccctcccctccatactctcttcttcttcctccttcacaacacccctcttcttcttcccccccaaggaatgtttccgaccccccttcttctttccttctattgtttttgttgcattatgctagttcatgttattctaatgtagtgttagtgataggattttgttttgtttagttcttcttctttttagtgtaatttcgttttaagtatatgtctggtgaaggggctgtgtttttaatgtttggaatggtgttgttggtgggtgatggttaacaaaaagtgtggaatgtgagggtgtagaagatagttgaattgggaaagttttcttgattcccttggggccatgaatatgaagaaaatgccttgcccacaatgtgtttgagaaattgcctcaatggtgatataaggagatgttgtgacatggttgtggtgaagtctgagtaaccacccatagtcacacattttaagctcatcctaatacgtgtttctctttttgacaggtattatgagttctgcccgtaagatacgaaacaccgggtcctttgctagtggcccaggaggctcctcacgagctaggggccaaaccagtacaccacggtttgatagcactcgattcgtctttgcagaagcagaggcaaggtacaatcaaaaacttgccagaaagttactccatgaggtccaaatcgacaggaaggctttggtgagggaatgccccaatatgtttgatgaactacggaggtgtcagctggacatcttctttgagactcccgaggaagcaaatattcagctagtgagggaattctatgcaaacctgccagaacacgaggacaaggttgtgactatgcgcaacacccaagttaatgctgctatagaggtcatccgcagagtgtatcgcctccccgcattcacgggtgatgatcattacatcatggctagtcgcccgatggttgactgggatagaattctggaggttatctgtatacctggcagacatcccaaatgggtagcacaaccgacgactctgcattccaagtctcttacttgggaggccaaatgttggctcactgtcatcaccactcagtttctaccatccagcaataccaccgatgtaaatgggccacgggccactatgatctactgcttcatgactcaccaagggtttgatgtcgcctgagttctctctgaagaaatgttcatccgatagcccgaactaagcaaaggccactacttcccttcgtttgtcacccgtatattccgccttgctaatgttcctgagaactcccgagttgatgggaaattacctataaaaaacctttccgggcgagaaaaattgggcaagagggacgagagccagtacgacgcaataatgactcgtctgatgattctgagtctgaggatgattctgatactgctgaagctgttgagatcacagcccctcctagaggggacgaggcaggatcgtcacagccatgccggagcactcaaatggatgctttggagcgggaaatgactagactgcggacctccgtcaccgacttgggatcctgcatggatgttgtggctgaccgacaggtgaagtcggaaaagaaattcatgggttggttgagagcactgggttgcgcctgcaacgtgaacccagacacagtttcagatcaagagtgacccttcacggaagtttctttacctcactactttttatattaccaagccatgaggacatgttttaattttaagtgtggggtgggggaaacttcgttgtatgttttacttgtgaatattatctgtttgtttttgttttgtgttagttgctttagaaatagagtaacagttttttttaggaagttaaaatagaagcgacttgtcccgacgatggatctctttcggcggggttcttgagggactaagttgagagaaaaaaaaattgaaatataaagactcttcctaatgacggattctttagacaaattttcttgagggaagctagtctatagaaaacaacaaaaagatttttttttatttcttaggtagtgtagtaactcccccttggtttttctttgggccacggttcttttccaagggtttagcttgaaccgggtataggtagatttgtttttgttttaggttaggattaatgggtgacgagcttaaaattgaagaagaaaaacccttagcgttcttacacccgaacacgatagatgctatagtgtagcgcttagcttcaagggttgaatcttgtttaagtgccttaaaaattgtatgtttgtacctaacttgaacactcaaaagagaatgttttgataaactaatctggagtgagtcatgtgccatgtgggtgtgagtatcattgtattccatgttgtacatttgatgcctagaacttgccctgtgtgtttataaaacgaaatagtagcttcattcggttttagaagtgatataggcatttctttgttgagccaaacatataaagtgaacccacctgaatgcattacatcttagttaacctcgttgagcctataagcatgtttctttggcaaccacaatgtgaaccttaaccacttgtttgaatagcctgttgtttgaactaattttcctccctctcactaagcactagattggtattgagattatgtgaaaacaaaagtgtggggtggtggtttggtttttgaagtggaaccgtggaaatagagaaaaggtgcagaatgtgaagcgtaaaaagaaaagcaccacgaaaaaaaaagaagttcatatatattttgtagtgattaataagtggtagcttgtacaaattacacctaatgtatggggatgattaaataaatgtggtggagtgttggattacaaaatgatgatttttaaattcaacgtaattgtattaaaagtgcttagggaggttagtcactatatccaaatgtatcctacccgtcccttagcctacattacaaccaaataaagtcctattgatcttagactgagtggggctcgattagtcgagtactatactaggggcaagcctatggtgcatctttgtggcatgtgaatgttatttttggagagtgagcgaattctgtctatttgagttcctaattattatcactatcattatatatatggaactactctcttgtgtgatgtgagggcatgtgactcacaaaggaaaggtgcattttgactattgtgtagagtggtttgagtaagtgcaaatgttacagggtacgaaaaacttgattcttgaggtaaaagttgttcactactaggtgtaactcttgtgaaatgttcatggcgtgagtcgttgagggaaaagcataggaaatgaatttttatggagtgtggtgaattgctcgaggactagcaataatttaagtgtagggtgttgataataggctatatagttgttatttataccataattgcccatgctttgttgttgttttataatgtaagttgccaataaaatgctttaattaatgctatttggtttcgcagggaatataagatgtgaggaagcaacatgaagtgtttagaggcaataacgtgaagaaaacacccactcaagaaatacccaaacacaaaagagcaaaaagagaaggaacgcggagacaaaaaggcccagcacacgctccgcggttgccaccgcggtccgagccgcgattggaggcagtgttctccacggtcagcgccgcagtcgacgccgtagccgcggcggcaggttcacagtccagaaagttaaggggccaaagtgtcaattcggggaaacttttgtaaaactcttataagatgtaggaaactcgcccaagagaggaaaaagcttattttgagattattttggcatgaagaacaagtgtgagagatcgcctaaaacatcatagttcttattctcttctatttttcttgcaattttccattattttcgtagtttattcttacgttgtcatgagtagctaaatactctaatctaaggttttggtgaaacccgttggggatgacttggttgttatattaatatagtttgaattggttgttaatctctatttgttcatctacgttttgattgtggttagttgaaagggccctcaattatccgtttctatttataatgtatcttcttgagagagagtgcatatttaggtagttgtttggacaacatcactcccggagtatagacgagagtcataactgagggtttagagattggattagagatcacaatagctcgggtgcaatctaaaagaacggtaatgtgaatctagctagcgtagcttgagagagtgcgtctagtaaattatcataattgcttgagagagatttatgatagccggagagttcttgattaatagagacaactaaggcatcactataagaaacgtacaaccagggaaatcaccaacgggagaatccattaccttagaccttattccaactgtttacacatcaagcatagttaattttcagctgttaattattttcagacttcagttgttagaaatatcatcaattgtgaattacaaagtttggggaaaattgattatgtgaatttagtaaatcagtcaaaagtaattgataggttaattctctgtcgttcgactatgggcagaattactcagattatatttgctatgtctgtgtgtgcttttgtataaggcatagtttgacgttatcaccctcgcattcacgaagggttagctggtgaggctgagattttagccttcacattcacgaggaaggctccgcgttcgcaaagaactggggttgttgtgcatcgcgttcgcgagagaggctccacgttcgtgtagaggaagttgggcagctggatttgaggttgatttgtcatcgcgttcacgagaaggggagcatggggatgaggaaccatcgccttcgcgagggattggacgcgttcgcgtaagagaaaatatggtcagttagattgtgcttcgcaaacgcgaggcgttgaccgcgttcgcgaagaaggaattgaggcctgggcagaatgtttaaatagtcatcttgtccgcgattttggggttaacttccaccatttttgagcgattttggagttttttgaagaggattgaagagggattcaaggggaaacacttggaggtaagatttatggacttaatactcgattctaatgtgaattttacctaattaatcatggaaattaagtctattattgaagaactagggcttgtaattggagacctagaatttgggatttgagaggtcatttgtggttgaattttgatgcgtttggtatgaatgaactcagggagtgataaggagtccatattgatgtaatttttatcggaattcgagacgtgatcccgggggtcgggtttggccaatttcgggatttatgttacaatttgatttttttcgaggtgcctttgttcccttagcatattttgatggttttgcactgattttggttagatttggagcgtccggaggccgattggaggggcaaaggcatcgcgagctagagatttggaccgggtagaggtgagtaatgactgtaaatgttgtcctaagggtatgaaaccccatatttgcacatcgttgtgctatattgaggtgacacacatgttagatgacgagcatggggtcgttcactattggggatcatgacttagtccatctcgaatgattgttttaccgcgtatttgactgaaaactatttgctatcatcatgttttgggttgaatgccatatttaacctcgtgccaactatttgaacccctttatgggatttttactgatctttcctcactgttttgactttatacttgaactcagtcatattatattctactgttttcataactcagtcatgtttactctactttaacactttaaatgacatttaaaatgatattttgggctaagcatctactgttgcccgagtggcttgtgagattctgactaaggccaagggcctatgttgtgaggaaacactgattatgttatgaggccgggggtctgatatttgtacgccacgagatggcttgttgaaatgagatcgagagcctagtgatgatgccacaagatagcttgatattgcgcttgggccgtaaggagcccctccaggagtctgcacacccccagtgagcgtgaatacccattgtgatgtgagatataacccgtgaggctggtgttatttatgatattgcccgaggggtggatttttgttgactttgtgccgaggggcgattctttatgtgtttatctttcctagttgactgtgacttacttgcttaattgttaaaaaagcatttttaagaagtttaaactgagctaaaatgacttcttatattttattgcttcattgttttactgtcttttactgcttctttacagcctgttgacgtgcctttgcatggtttcttattactcagcctgcatttattattattactcattgagttggagtactcactttgctccctgcaccccgtgtgcaaattcaggcgcatcaggtcctgcttgtgagggttgagagctgtccagcaaatttcggagattcactaggtaactgcccggcgattcgcatcccagtgcttctccctctatcttatttcgttctgttttagttatataatagtggagtagacttgttcatacttttagtattattatagatgctcatgactggtgacacctcgatgtcgagctatgtctttttccgcaaactgtattatttaccttattttgggttttatgattatgattaagacttagtttttttacttaattgcttaaaaatgaattgggaacgcatcggctggccttgtcttcatgagaggcgccattacgaccgggttcgggtttaggtttgtgacagctgcaagatagaaggtagcaaccgttacgagattagaaggaattagatcacaagtcatggcgtgggaaataggcttaaaggagggaatgccctggactttggatttattcacagaacaactgcctaaatggcaaggagagtaggtattcacaacacctataagttatgaaaatgataagagcatcagtcaacattcgaggacgaatgttccaaacaggggaatggtgttacgccccacaatattacgtcgatattatgtcccgcaatattatattacgatgatgccacgccttgcagtattacattatgatgatgttacgcttcgcagtattaaattacgatgatgttgcaccctgtagtattgtacgttgaatttgtcttaaggtaattgacatccaaggggaagcaagtcaaaaaataaattttcgtccaagtttggcatgttgggataaaatacgagccgagcgttaatacccgatatttatggactagtatcatataaggtagcatatgaccatgatattatgatgtataaaatatattaaaaatgagtaatattttaagtaatttgagataattcttaattatgtgggtaattggttaattatcgagtaacgggacatcatctaattaattaattagttataagataagattaaaacaatcccaccccatgtgacagcaagccactactaagacatatgactcttagtcatattgtcttaggtggccatctcaagtaaggcacataaagccacctacgtataagacttattcaagtttggtttcatttatacaaagtttggtttcatttgattttatttatacaatctttcttcctaattcaaaagctctcaaaaaacagacacaaaaacttggtttcatttgattttatatatacaacctttcttcctaattcaaaacctctcaacaacagacgccaaaactcaaatccaacaagcttccaacaaaatttcttagctctcaaaaacagacacaaaaacttggtttcatttgattttatatatacaacctttcttcctaattcaaaacctctcaacaacagacgccaaaactcaaatccaacaagcttccaacaaaatttcttgcgaccaaatcaattccagcgagaaataattagcacctcagcaatgtaaaattttacggttctaaaggagtacggtgcaaccttttccaagaatgtcatatgaatttttccctactccaggtatgttaaggctatccttctttctttttggcataattcatacgacacgaacgaaacgagtaaatgcacaactttcataaatgactctattcatagaaatactagagatgctcatgttcttgattccccatgtgtcatattattctatcatctgttcatgggtctcagaatatacataagttgagaaagtttgtttcatgatattaatcagaggtatgatgatcttatgacgtatcgagagattttttattaacgtatttcatatgcatttcatgtatttatacatgcacattgtctcatgaccagatgatgttatacgcgtatttatatgtatatatatgtatatgggatatgggaaaggttatggcgttatatacgcaccaccacctgatcagctggtatacgtacgttgatgattttgcccacgatggctgagataatatgatgggatgccctcagaggcttgatgatgttatgagcacatgtacctatacacggcataacattcatacgcatatgcatgacattataattatttcatgaattacagagttatccagacttacaggttgagtcatttactctatatttcttccatgtctgttatgtacttatttatgtgccttacatactcggtacattattctactgacgtcctttttttcctgggaatgttgcgtttcatgcccgcaagtccctatagacaggtcgagagccctccaagcaggctatcaactcagcggaagatgttggtgtgcttcattttcttcggggttgcttgtttggttagtatgacttagacgtgtattgtttggtatggtgggactctgtcctgacctttatgaaaattatgtattcttagaggcttgtagacagatgtcatgtacgtaaaatattgtatggccttctcggcctatgttcagtgtacgagtggttattttggccttataggccgtatatcttatgtataagttggtatcacattttgtattctacttatctcacagtagccttccagctcagttatcaatgatagtatgacatgaaaagatacgttatgttggtactcggttgagtaaggtaacgggtgcccgtcgcggcccatcgatttgggtcgtgacaattccaaaactcctttatcaatatgatgatcctttacttcaacgtaggtaaaagtggggaaagtttctatcaccaaattatcgagtccacgtgtagcagcagcagcactacggcggtgcatagaaagtgtttgacggatgctgttatcgttggcggcgctgtgactgcggttgtaaattgagaaacaaaactctatataaatctctgtcttcctcttcgcttcgtcgttctagggttctgcccaatctgggatattctgtcccaatccacaagcgccattcaaattcaattgtaaagaatagtttttttgaagcgtacgtgaggctattatggtaacaggaacagtgacgtttcgagtcaaaatcgcggccctctcgacgagacgacattagggttgtttttgaacaaagacgacggagtttgggctgagcaactagaattttctcttaatatatttcaatgtatttcaatgtattccgtgtattttattgtattcactgtctcgttgtattccatgaatgtattcatttatttttttaattaatataatttatgtattcagatgtatatatgtattcaaattgctttgttttgttgtatttatcggctgggaaaaatattcagcatattttctctgaagattgctatgttttcggggtatttttcggttgagaatcttttttataactggaaatacaaattttatgtgttataattgagtttgttgagttatattaggagtctattatgttaattgattcactttccgtttaaaacggttgaatagactatgaattgcgttatttacattattgtattcacaaatacatatcgtgaatacagtcgaatacaataatctatctagttgtaatccattgtttcacgccgtgaatacagtcgaatacaaaaatttgtctagctgtaatcacatgtttcacgcctaaaaatgctactgtattcatgaatacaataacttaaatacatcgaatacattctaaaaaacctaaaaatatagctatataaagtaatataactagctaataaccactaaaacatagtggtttttgaaagtttctcaaaatgttatcatctcaacaaaacaaaaaaattgatttcgagttaatattaacagtttgaatcaataattattttctttaatgagaatgaaaaattaagttattgaattaattaatttagcaaataatcaaatttaattatttttaaattcatcatatacaaaaattatttttcaagttgataaaacttttagggtacataaatttgttttaccaagaagaatattggcgtgtaaagaaatcaaaaacaaagcaaaattaattatagtatagtattaagagtcacattaataagaatacgaacttgaagcaatgaaacaatagaaataatttgaattatgaattatgaaaaaaattgattattagcacacaaaaaattgaattatgaatgaattgccgttaattattgtttttctttttacactcgttccaacaatttgacagttcgtcgtaattttttacatattaagttagtattctatattaactgaacattagttatttttatactttaaattgttacttatcaattctttaaagttatacgtcaaactcttcattttcaaattttaaaaaaaataaaagattctgtttttaaatttattttatttcacaatttcttaaataattataattaaagtattttcatattacttgttcatttttactatttgtcacaaaaataacagcaatattttaaggatactctcgcataagtcatcacgaatcataataagtacccgaggactaatgtgaggcaagatttcttttttattaagctggttaaatgagatcactgttaattattttcgaaaacttagacctttttaaattttttattttttaactcaaacacattgtttaatttaatatttacgtgcttttctcaaagttgtatgctgattgttatgagccacatgtgcaaagtgtgtgatgccgtacccaaaagctgttaaattgaacagtgttaaatgcagagaaaattcgaccaaaccatttttgaatgccactgttaagatgcttagcaaagcaaatggttatatatttccaactcaggcctaaacccctatagagttaaattgccttgtttttcacctctttgtattcaaatttattgagaacctgctatgatataatgtaacgccattgtgcatcatttcacattgtttataacataatataggattatgttgcactcaagggaggttcaataaaattagtggcctaatgccaaatttaataagaggtcttatatttttttaaaaaaatattaaaattcatacatgtatacacaacaaatataaaaaagttagtgttgtcattttattatagtacttgtttttgtaatataatattctcaaatgctgtaagtcatttaacttcccgtagtaatattattgtttgtattagtaagaggttattgaaataaataagatgttatgcatgtatttacaataatagtttttttgatatttttgtaagaaattatatttactagtataaaaatttaagtattttaattcaaagttttgaaatatttctatcgttaaaaagtaaatgctcttttatttttacaatttttttgtacttttttttttcctgcaaactttaatattgtctaaactaaaataaaaccataaatttactgtggagcctcaaaatctcgagggcctagatcaaagctttattgcctcctccttgagccactcgtccatccctgacattctcaatcaatttttatagtctcaattaacataagacaataatgataaaaaacaatgaatgtatcattcagttaccaaatgtgaataacattgtttgaacagtacgtgcataaggcaatggtcttagggccaaactaaaatttattaaaagacatttaaccctttttaataaaattcatatgataataagagaccaaaaaaactacatggctttgatctagtggtgagagtgcaacacttgatgtgtgggttaggcacgtcatggtattaaactctcctttatacaaaaatatggtattaagtaaaatgataaaagggtgacccattattcatcaagttttgaaccttgcgacacttgctcagaaatttcttagttaaaaaggtaagacacaaacgaacttgctttttgatgtatgaatcaatcaagtgggacaaaaatgaataactaaattagagaatttgagttgaaactaaaaaagtaaaatcgtgagaaacttgaaaatagactattcatagagtaagaaaaatagaattgatgaaaaggtaaatatattaattgatttaatgatagtgaaaatttatcgtattaactcacttgatcctaactagaccaaatttaaaacaatatttaaacttaatttgtttactaatatatatatatatatatttgggggcccaaggcaagtgctctaggcaaggacttgccctacccaaaagccgcccttgtttgcactatctatttaaatataagtgttcaagataaataaaaaaaatcagtccgcacttcgggtacgattttggcatgcaagtgctcatcgctgtcacaacaacaatatatccaatgtaatttcacataatgtatacgcaaactctacctttattgtagaagcagagaggtcaactgcttagagaaaataggcatggccatttacaatgttacaattcctttttagatctcttatgtgtaaaagatagatctctcatatgtaaaagttaataacccgactggtcattttgagttttagcattttgtccagtggttctaggttttgagtggcttcataatgtgcattatgacttgcgtgtacggttaaattcgattttcggatttttcgggattgaattggataagtggttctcattttagaaacttaagttggaaatgttgaccgatatttgacttttgtgaaaataactccggtatggtttttttgatggctctgataggttcgtattgtaattttggaattgggcgtatgtccgaaattgaattcggaggttcctaggttgattggacttcttttgtcgaaagttggcaatgtgaaagtttaaaaattccttaggtttgaccatggtttgaatttatggctatcgggtttgaaatttagttttgggacttggaataggtccgttttgttatttggaacttctacaaagtttggcgtcattccgagttgatttgataggaatcggacacgcgattgtgtttataaaagttactgagtttcatgtaaatttcatgtattttagaggtccaactcatggtttcatatgtttttttgattgtttgatcgtgtgagcgagttcgtgttatgtttttagacttgtattgatgtttggtgtggagccctgagggctcgggtgagtttcggacgcatttcggagtgcttgaaggagttctatcttctggtggtttctgcacatatgctttaggtctcacgaatgtgagcctgtgttcgcatttgcgatatcgcatttgcaaggtgggacattgcttgtgcgatataggctgggactattgggtttgcatttgtgaacttattgttcgcatttgtgatggggtctaggctaggcagtggtcgcaattgcaatcatttgtcgcttttgcaaaatattcagtcttcacatttgcgatgttagtgttgcattttcgacattaccagtgttgtgatggatgtcgcttgtgcgatcattcttcgcatttgcggggtttgtatttgcgaaccccatatcgcatttgcgatacctgcaccagaacataaggcctgaaaatcgggagtttggcctcatttttcatatctaataaccctagactcggtaggaggcgattctaaggagggattttcatttacaatccttgggtaagtgattctaaccaatttccaactgtattttatgattatatataatattgaacatcaaattcatgagaatctaacagaaattttggaaaattttgtctatgttttgaaaaatgaaattttgggatttgggagtcgatatggactcaaattttgaaataaaatacatatatggactcatgggttatgagtaatgaagacctacccttagacccggattttgaccggacacgtctgggttaattgtttgggaattgtatgaaggtcatagctttacttattagtacttgttcctcttgcattatttgatgttatgaattgattttggttagatttgagtggcgtggaggtgaattgtaaagggaaagctatttttgagagttgattgggcctagttgaggtaagtatcttgcctaacttcgtgtgcgggaactaccccctagggattagtttgattatattatttgtattatgtgaaagacgtgtacacgatgtaacgagtgtgtacacgagctatatgttgtattttgactggtatagacttctagacttcttccatgcacttaattgaacttgttattgtcacacctcctttttcatacaccccccggaagagggatgtataaaggagtttttccaattaaaggacaatcgaaacgggatttatttattaaaaaatttagagtcgccacttgggataatttatggtgtcccaagtcaccggtttaaaatcccgaatcgaggaaaggttgactctgtattacagtccgcgaacatagaaatccgggtaaagaattatgttaacccgggagaaggtgttaggcattcccgagttccgtggttctagcacggtcgctcaactgttatattcggcttaattctctgattttaaatacattttagcctatgattcaattttaacttttataaccgctttatttaatttttaaagaaaattgcaacgttattaaaacacgtttcgaaccacgtcacataaatgcacccgcagctcttgacatattctatctaacattgttgagatttagatttgggtcacataaatgcacacccgagtttaggaaggtagattattaaaataatgcgcctaaagcaactacgcatttattttttttgttatcaatttatcagaaatggtcatttctacctattagaccgatacgtaattaaactatgacacaaatccaaactaatgtgatttaatccaaatagaatagtctcgtcattatctcttatagtctatttatcactcctacgtgttttaaacattaaaccgacgtctcaaattattgttatggcgtatacttatcctggttccacacaacgaaagttaattcacagaaacaaccaaacaccagcagttaaggcatacactactaatgatatacgttattctaaaacaagcatcaatgaaaaagaagcagcgatgcaccagcaaagtccatcaaagctatttgaaaatggagtaatgtcatgaaggaaggaactgaccttttaattaaaaaaactgaagtcttctagtacagaggaatctaaaatagtgagaaggatcccaatggaccttgaaaggaaagtcaacaactgactagcacccgaccggaacatacgtcggcgattctagcaggacctttactgaccggaaaactcgatgatgacctcagcggcaaactcgaatctcttactcaacgactaaatggaaagcttgcaccagggacctcgacgaacccgacacttcaatatatggccctgtacggatctcgcaaacgaactccaagatggattcaacatcgacaaggaaccagcagaatagtcatcgaaacacgaccagaaaaactcaagactcgccggaaaagtgttaaacgagcttttgaactcctcactgttttcagtgtgtacgtgtgtcgtggttgttttctcgtttgagctggtgatggagtttggcagctatggaggagttggttgttgtgtgtcattggtttcaaaggctgcgtctggagctcgtaaatccgacgagctgctggagctcatttttccgacgagtttcaggcaaccgtggtcagcgttgtttgcctttttcgttgttgggtgttgccggattttccggcgggtttggtagcgaccgatggtactggtgaagggtgtgagtgaagagggttatggggtctgttggtttttgggttatgttgctgaagcagaaaaatgaaaagaaaaaacggggaggaggggaggttcgaagaagacgacctcaaggggtggtggtggttttttttttcaaaagctgcacagccttttctgtcagctttcccttcagcgtcctctcttcttctttttgatttttaagcattaatttatagctagagtctaggtttaggtgtatttttgtgtattttgcccattagtccctaggtcttttgtgtattaggtccttagggtctttttgtttgtttttattccaaagaagagtctagaagggtccctaggcttaatggactaatccgacttgggccaagaactaggttctaaaactcttaaaattatgatccaacaccttaatcgactccttttaaaataagataaaaatactacataatgcaaaagctaacatgaaactattatatatttttttgtattttcaagatcatgtaaagataaaaataaggtactatttttgtgtatattttttatttaaatttatgaaagatacgcaagctaaaatattttttgtaattttccatttttatgacgaaaataaagtaaagaagtcaaaatagttgaaatagctatattaggcctaaattaaatatttacgcgctaaaatatgaaaaatcttagggagagtcaaaaatcacatgtctacagctgcccctctttgactggaaagacgtagtattttcagacaaagaatgaccagacaggttttttgacccgacccttatttggagaaactaatactaagagagaggggaatgtgaccgagctatggtatctgatctgcctacatatccttggctataaaggaatcaggacacgtgtagttcagaggtgagtgagatgatggagtatgccaaggtggagagccggtcgaggtgccgttccgccgaagttccggtccgcggtcctgttattacatcaaaatcaaaaggaatgaaaaagactaactaagtctgtcaactacgagttataagattcctatctataagtcttctgaagcttaatcttgagtcttgaatggttcttcatgcagactttggatttgaaccttggcgcttgttagctgcaggtgctagctcgttcttctatagctttttggatcaagaccgaacatgtagtgcttgtgacttccaccatgtcttaagcagttcacatcttccatcaacttctgcatttggattcactttttgcctttctctctttttcctttattatgactaacttctgttgatcacctcggactgttgactcgcatttttgccgcgagctccttttgttgctgacttgaattgtaatttgagatgctttccctttctccaggtggatacctgattgctgaactcgaattgtactttgagatgctttccttttctccaagcggacgcttgactgctgaacttgaatgtattccctgctctccaggcgggctcctaacttcaataaaatagacaaaaataaagaaaatttttctgccccaaattgggtatctgggcacatatgtaagtgtaaaatgaactacattaccaaatatcaataagaacttgaaagctaaaacttgagttatactcctttgttctccaggtgggctcttgattgctgacttgaaatgtattccctgctcttcaggtgggctcctgactgttgaacttgaatgtattccctcgttctccaggtgggctcctgattgctgacttgaaatgtattccctgctctcctggtgggctcctaactgctgaacttgaatgtattctctgctctccaggcgggctcctggctgctgacttgaaatatattccctgctttccaggcgggctcctgactactgactttaaatgtattccctgctctccaggcgggctcctgactgctaacttgaatgtattccctgctcttcaggcggactcctgactgctgaacttgaaatgcttctccctattctccaagtgggtacctgattataaaaaaatgacaaaacaacgaaaattttctgccccagtttggtaattgggcacatatgtgagtgttgaactgaatcatattaccaaatattactaagaatttgaaagctagatcccattatccagggggtcctgacaactcttaactaaacgacaattttaaatctaagctatatcctttaaaggtgtgacttctgctaaatcttgttatctaagaaggtctttaaactattccccattatccaggagggtcctgaaaatcaaaagtcaagttttatcttaagagtgacaactattatggctgaattatactaccctacagcaaaatttacgctaaatgttgctatctaatcgaaattttaaagctaagtcccattatccaagagggtcctgaaaactcttaattgaatcctatctcgaacatgcaaacttttaagccaacttatattcctttgggatgcatttatgctagattatgctatttctgaacatttaaactaggtcccattttccaggagggtcctgagaataaaaaatcaaacctgtttggtgactgcctttctttacggagggtttctccgaaacaaacgaaattttcttcccctgtttcaaatcaaagaaaaatcttgtcagtttaaaaatatggtggttggtttgtggccttgactttgaggacggttgctccttcaattcccatgataactttgatttccactcgaagaccttgcttgtttattgattaaccactttctctgtcacccttatcacggaaaatacttctgatctgttccaacccaatacccttcatctattgcattgtgctcttgcatgtactaaacctttgtgtttctcatgaatctcaaagcacgacaattgccacccactcattctgcatgttgtttttcttgacttaaatcactgaccctggccttgaggtctgttgctccttcacttgccacgataactttgatttcttctcggaggacctcgcttgtcactgattaaacacctttgtcaatcttaccacagaaaatacctttgatccgttcaccaaacccctccatcttgttgcattgttcatgaattgatatgcaccaaaccctaatgtttcaccataaatacctttgatccgtttacctagcaccctccatctgttgcattgttcctgaatttatgtgtaccaaacctttgtatttcacaagggccccaaagcatgttgattgttaccagctcagttcgcttgttgttctttcctgacttatgacactttgatgtattggccaaatcccgttttgtgcaattggaaagccggtggcaaattttgaagtcatttctcacttattttgaccaaacagactcaggaagaggaagtaaacaagacaaaaggaacagagtaaaggacaaaggaaaaagatgattcctaacaaaaaaactacaaagtagaaacctatcagatgtggacaccaactctaatgaccgtagcatgcacctgtgacctattctgtcaagtaggtctgatgttcaactcctattataccccaaaccgtgaaactggacttccatgctccgattatccaatctgattcacagtccttattcgatatgtagtgctcgaggggttttcaccatcaagcctctctcattctgttctttctctcaacttaccgtcgccttacgatgcccgcgagggttttcaccaataagactcttcatttttggatttctcccagctcttgtcgccctacggtgcccgtgagggttttcaccaataagactctctcattttcattatttttctgcttgtaccagagtgttgctcctgatatgaattacctctccttgcttgacttgtcatctctcgaaaactgatcggaaggtttttctttggaccgtaacgtgggctttttgatagggttaaaaagaaaggatatcaaaggctcaaaacaattcacatgggttcaaaattacaactttcggaatcagatttcttacaacaaccacaacttctgccccagtttcttgcttggggacttttggatttttattttgatgggaccgaaccatgaggctgcctacatatccttaaaaggaatcaggtcgaacgtagttcatgtcgtaggattgctctgttgttgtgatttttcttttctctttctcttttcttttctcttttgctttcttttcctctttttgttgtttttcttcttcttttttcttttcattcttttctttttcttttttttctttttttttttcgattttcatttttcttctctcccttttcgttcttttcttttctccttttcctttacttatctttcacgcttgtgtttctgatctttgctgctaattttgaaagaggggtatgaaagaaaataaacaaggctcaaaggggtaacgaaggataatgtgtttagatagtagaacaaaatgcctttatcattccaatcttcaaaatatgccaagtacaaataacacaattaaacaaaccaaggaagacattcgtaacatcttttgattgcgccagacttgatgaccatatccacacattcgccttctacatctgttacagacaaagcaccattggacaacactctcactctcactaccacgaacggccccctacaaatttggggcaaacttgccgttatcttcatccgatgcaacatgatgcatttcaatagtgtatttttatgttctatctgccccagtttcacacaattcgggcttgaagtgatctcaaaatgccttcacttatttccctccaatgtccctacatcttcaacattgtttcgttgcttcgtgactaaactaactttttaagaccatgatgagaattacgcgtgcgtgtcatgtcactagagtcaataggaaaataactataaaagtaaaagacaactaaacaaaaatgactaaaaataatagaaaacagaaaattgcattagatagatggtgaaagggtttggacaacaaaacaaataaactaaactggggtcacaaacctagaacaaacctagagaacactagtcgggctactatgactaaacaaactaggtaaaataaaaggatagaagggtttgagtcacaagacaatatccggattacaaccctgaaataacccggacaacagaaatgacaacaaaataaaccaccaaaattcctctccggctaaccaagaaaggagcgtctttccaattgccaagctcggcatcttagccactgaattccgcctcaacattactaggaccttcacaaacttccatcacattattcttaataaattgcttttaggttccctttgctggctcgttcttaagatcaacctctgatagcactgaaaactttatagcgcgtggaccttcgaggatctcagaagaattctcatattccttttcaaagcaaatcatactcaccatatgcgtctcattacgaacaggcgatggactttagctagtgtctgctgcatctggattttgcacgacaatgtcacctgcatcaataagcttttgaattgctttattcagattccaacacttctctatgtcatgccctggggctctgagcaatatgcgcacctttgagaaaaatcaaacttctttgacagagggtttggcatttttatatgaatcggcttcaacatgtccaattgcttcaacttttggaacaaactggatatgattctccaataggggtgaaagccttttcttttttcagcaacctctcgttcttaaatgcttgattgggccggaaacctaatctagggggttttcggtaggctcgtaggggtggataggcatttggtggagatgggtactgggaaagtgttgtacgattttaggagttccgtggagagaagtggcattggggaggatcatctagcgcacaaggatatccatagggacgatgtcaaggctggaattgttgatcgggaaagcccatcggatcatcttttctgtttctctttcttccacccaaacttactggggtgttctgaatgtctttcgaacaactcatgattttgcctgacttgattccctcttctactagcttccccatttttaacatatctttgaaaggccttcccaaggccgggatcaaatggctgaagtaggtgggcccctgggcttgtaggaaaagctcaaccatttctttttcaccaactggggtattgactcgagcagcctgctccctccatctgagcccaaactccctaaagctttcctccggcttcttttccattttagatagggaggagcgatctggggtaacgcctgatttgtattgaaagtatcgaacaaaatcttgagccatgtcacccaacgtaggccacttaccaacatcttagcgattatgccattccaacgctaccccaatcgggatctcactgaagtacgccatcaacaaatcatctttctctccaatacttctcattttactgcaataatccctcaaatgggctaccggatccccacacccatcatacaagttaaactttggcactttaaaccccgtaggcagacgaacgtcgggggacatagacaattctttgtaagacatgctaccctggtctcccgttcattgcttgttatttaaggactgttctatgcctttcggccccctaggtatcccatctcacccctttcttcctgtgaacttttcatcttcaacatgaggctcatctcgcgggccctgcttgtatgagttaggaaccttgtgggcaatctctgaggggtaatattgggcatcgtgagctttgagtgggtgttcattgttgggaatggtggataagacaagagggcaatttttgggaaaggtaattggaagatgggtgatagagctactagggtggttggaaaagccatgataagcgggtggatctggagagtatggggaatcatctggtactgtgaccggtgtttgggtaagggcagcatttaggaagctaggtggtggcgggggtggtgccttcccagtcatccaagcctgatacatgtccgccatgtgttgtcttaacatctttacctcttcaaccaacctattgtcctgttcaaccaactgctttcgggcaccggtatcaaccaactcagttctgttattgtctgtcattaccttttgactttatgttgtagagaagagttacccctttaaaaccagaaaccaaccacccttctactatgaatataacaaaaatgaagccatcacgttagcgttagggcatttaacataagataatctcacattatgtgcaatgcacctagccatagttatcggttctaaaatgacttcgagggtacaaaggtcagttgacatcatcccaatttgttcatttcaacctctcttttctttgcttttctagcacttgctagatcattttccttcctccttttctaattttactcttttctttcctctcatttctcacatcccacaatttcatctcttttttttcttttttttttctttttttccttttttcttttaacagtaaaaaaatgattcgatagaaccctatgtaggttgcctacgtatcatgacgccacatgaatcggatctttgcgtagttctggaagatcaggaataaaggaaataaactgacgttctctgtttctttttttttcttttctttttaccttaatgactactctgctgagaaaagagaaataaatgaagcaaatccttttttttgaattttctaaacttaatgttctataacctattttatactcaagcttaacggattttttttcttttctttgaaacaaaagatattttttgattcttttttttttttggaagaaaatctaaagagtgaaccacagaaaaatatttagaattttcaattgatatcctgatgcaaggtttcgaaacaagcaatgaaaaagataaaacaaaatatttttggatttcaattttgattgcctaaagaaaaaactctgaaaataaaccaaagaaaaagtattgttgttttctttttcttatatgtacaatgtcctaaagttctaataaaaataaaagaattttttttcaagtcatttttcatcaatttcccaaaaaaaaacctcaatagaaaatttttttggatttaatatcttaaaagaaaatttttaaagaggtactaaagaaaattctcttcgtttttttttgaatttttggtcttaatatactaaaggaaatataaaagcaatttttattttgacattaattgcctaaaggaaaaacaacctcaaaggaatttttattttattttctagaataagcattctaaagaaaatgtataacgaaaatataaaaacgcaattttttttttgatttttgacttgtaacacatttccaaatgcaaaataagaaatacaataacaaaagactatgcaaacttaactagacaatacaaaccctaacatcacctaaaagactaaatactactatgcaggactagaaaataaaacaaaaacaattgactcaaaaacataaaatggctcctcgagcggctcctgaatgcagtgatcctggggtatctgtcatgctcaaactccagtaagtagatccacacctgtatgagaaaacttaaaccaacactatgtgagacaataacattctctactaaacacatgcaagacatgattgaggctatttttgcaaaatgacttatttggccaaaaggtggttagaagtgcaaaatttggctaagatcctgcaaagccaagaacctatgatttactaggaagaccggaccctatgtgggttgcctatgtatcacgtcccgaaagacgagaatcaggtatgcgtagttcgggcagattggatacgggcaagaataataaaaaaaccactaatttatagaaatcacattatttttgttttttttttgaaaaatgacgaaacatgcaaaatctttttggattttttttcttttttttttgattttcgacaaatgatgaaaaagtgcaaattgtttttgaattttcaagcttttttttaacataattgggcccaactcgctttatcttcacacttcaccctctctttttctttttttttcttcttttctttcattttcattcgccctcaactaatattggtccgccaaatgacccttttacccttgaataaatgcaacatgtagcacataagatgcatcaggatgatcttttattttctggggtatacctgtcctagacggacccaacccctgtgttgagtcccctaagtcaagtgcacatgatggaaacaagcgttcctactagggatccggcatgaaactgagttattctaggttcaaaacctgggcagttgttctagacttgtgtaccccagcggacaacttgagccgaggatggggctacgtaccgggaaccaaaaggccatccgacttagtaacttgtccgagcctctttcttatttcaaggtatgacactaacagaatagggagtcttgactagcgagcacatcccgaagatgagaagagaagagtttcgtagcagtttatatacagttcagataatatcaaagcggtaaaagcaacatttagcacattaggcccaaacatgtgataaaatcagataacagataaaaccaaatataacaattcatctaagctcgaattttgaaccctaaaccagagattctgggttcgttccccatcagagtcaccagagctgtcacacctcctttttcctacaccccccggaagagggatgtataagggagttttttcaattaaaggacaatcgaaagatttatttattaaaagatttagagtcgccacttgggataatttatggtgtctcaagtcaccagtttaaaatccctaatcgaggaaaggttgactctgtattaaagtccgcgaacacagaaatccgggtaaggaattctgttaacccggaagaaggtgttaggtattcccgagttccgtggttctagcacggtcgctcaactgttatattcggcttaattatctgattttaaacacattttagcctatgattcaattttaaattttataaccgctttatttaatttttaaagaaaattacaacgttattaaaacacgtttcgaaccacgttacataaatgcacccgcgactctcgacatattctatctaacattgttgagatttagatttgggtcacataaatgcacacccgagtttagaaaggtagattattaaaataacgcacctaaagcaactacgtgtttattttttatgttatcaatttatcagaaatggtcatttctacctattataccgatacataattaaactatgacacaaatccaaactaatgtgatttaatccaaacagaatagtctcgtcgttatctcttatagtctatttatcactcttacgtgttttaaacattaaacctacgtctcaaattattgttaaggcgtatacttatcctggttccacacaacgaaagttaattcacacaaacaaccaaacatcaacagttaaggcatacactactaatgatatacgttattctaaaacaagcatcaacaaaaatgaagcagcggtgcaccagcaaagtccatcaaagctatttgaaaatggaataatgccgtgaaggaaggaactgaccttttaattaaaaaaactgaagtcttctagtacagaagaatctaaaatagtgagaaggatcccaacggaccttgaacggaaagccaacaactgactagcgcccaaccgaaacatacgtcagcgattctagcaggacctttactgaccgaaaaactcgatgacgacctcagcggcaaactcgaatctccgactcaacgactaaacggaaagcttgcaccagggacctcgacgaaccctacacttcaatatatggagctgtacggatctcgcaaacgaactccaagatggattcaacctagacaaggaaccagcagaatagtcatcaaaactcgaccagaaaaactcgagactcgccggaaaagtgttaaacgagcttttgaactcctcactgttttcagcgtgtacgtgtgtcgtggttgttttctcgtttgagctggtgatggagcttggcagctatggaagagttggttgttgtgtgtcgttggtttcagaggttgcgtctggagctcgtaaatctgacgagctgctggagctcgtttttccgacgagtttcaggcaactgcggtcaacgtttattgcctttttcgttattgggtgttgccggattttcctgcgggtttggtagcgaccggcggtgctggtgaagggtgtgagtgaagagggttatggggtttgttggtttttgggttatgttgctgaagcagaaaaatgaaaaaaaacggggagggggggggggaggttcgaagaagacgacctcgggggggtttcaaaagctgtgcagccttttctgtcagctttccctacaacgtcctctcatcttcttttttatttttaagcattaatttataggtagagcctaggtttaggtgtattttgtgtattttgcccattagtccctaggtcttttatgtattaggtccttagggtctttttgtttgtttttatttcaaagaagagtctaaaagggtccctaggcttaatggactaatccgacatgggccaagaactgagttctaaaactcttaaaattatgatccaacactttaatcgactccttttaaaataagataaaaatactacataatgcaaaagctaacatgaaactattatatatttttttgtattttcaagatcatgttaaaataaaaataaggtactatttttgtatatattttttatttaaactaaaatatttttttgtaattttccatttttatgacgaaaataaagtaaagaagtcaaaaatagttgaaatagctatattaggcctaaaataaaaatttacgcgctaaaatatgaaaaatcttggggagggtcaaaaatcacatgtctacagttattgtcgcgccccctttttccttcgcggagtccgggtttcgacattcatgggggaacaacttgttttcttttgggaattgggtgtttgaagagtcgccacctaatggattaaggtgcgttagggaacctaaagtaattaactcatgtaaccagtttgcattagggttcaaaataaccttgaggggaaggtgtttggcacccctcgcggtccacaacggtgggtcccgaccaaacttaaactatgtgaattagtcatttaacaagtaagcggtctcaacacatatttgcaaataaaggtagtttacacaatctaaacacatatacaatcaagaaagataagcgtaaattaaggaggtttgaacagctcgagcatacataaaccaaggaagtttaggaggtctgagtactcatatgtgattgggaaaaaggaagtcctaagttgattagcctataggatcaatctgtgcattgcccggtaatcctcctcaattagaggggctacatatgtcattagcgcgtatgtcatcatatccttttactacccactaccctccccttagtggttatacaagcgaatttgattaacgaactctaagcgtgttgttacccgtccctttcttgtggtctcggaggagtttaagacctctagacttaggtagttctagacaatcctaaggtgtttaaaatgcaaaaatctaggcgacaacaaataacatgtaggactgtcaaatatgaagcagatagaaggctcatgtttacttccacatatatataggcaaataagcaacacgtctcaaacacagatttttaggtaatttctgagaaatcctagaacagggtatctaggtgagcatcaaaacacagaacatgcaacattattcttaaaacgaagtggtagaaccttaatcagtttgcctactgattttaaaaacctgttaaacctgagcagtttataaataattagagcatagtttcttagtttttacaaggacattaatcacctaaggtttgcctaggcgtggggctatacataatcttagttatagggacgtttaaacaatttgaagttgtttcaacctataggcatgttgatttaagtgaacaagtgattttatacagattgctgctgtaacatgatacctatgtgtgaaactattttaacccgttttatttgagcgacataaagcaaatgcacgtatagtcctacaacaagatcactaatgcacatggagaaggttgtttattaagtagttttaataatctagtgacacgatttctaagtgatcgtgaattatacaaaatcagaaatagagttatggtctacctcatgtttctagtattcaaagtagtaaacgtgagtgctaaaaaaataggatatctaatgcacagatttagcatgatttaatgcaaacaaccatatcaatcctaagcatggtatctagtgcatcacacagatctaaacatgatttctacagcaggtcaacatgtagcacaacctagaaacatgatttctacaacaagtcatcgtatagcaaagactagaaaacatgatttctacccagttttatcccacataagcatatatctaccctctcttttcactatttgccccaatatatgtatacaaagaattattacagaccaggattgcataaattacataaatgaaatataaattagactatcgggagcctgttgcaggcccaaaataatactgggagtaccaggccttcaatggtagtctcaaatgccgagaacctcatagccaatgaatgtccaggtgtgtcagagttccctaaggacctcaaggatcccgggcagtgctcacaccaagaccttctcacaatagggactggttatgtgcagtgtggaaaggccagccccgttgtgccagagttcaaaggaatctcaggaattccaaggcagtacacacactaaaggggcagaacctaatgatttaaaagtaaagtgagagtgtttgacatagtttgaaagattcggtgaaaacagtgtagagacgactctaggagtgaaaaaggctttctaaaacagaaactagtttggtagtgaaaaatagtttgagaagagtaccaaaacacttttgaaaatagcaaacaatcaattggtcataaaacacccagattcataaatacttaataaacagatctcatacatggataaagggattggggacacatagaattcacattaagagaacacatgacagggctttgggaggcatatagacaacaaaatgcatagaacacttaggagcttatagaattaataggttagtcatgatggtaggtaatggagccatgttgaaagcaaagaagcactagacaaaatcagacacacaactagagtcagtcgaatgccttaaaatattaggtaactaacatgatttccttagtgaaggagaatagacaagggcgaatagacatgctggacaaatatcaaatggacaactatagtttgtacatgctaattacatattgaacaaagcaggattagacatactaagcaagggagtaaacagaaacacgaattaaattcataactaatgagctagtattgtaatgaaacacatagagtttaggtttcaaaatttaactaagacataccagccaaggaagagagcacagaatgtaaagcaggtgcagttcaatatctagccttggcttatagtcggctagatcagtgattatcacaagtagtagagaagaaaaaagagttttgagtgtaagtgtgtgtttttgaactgatgttcgtgtgttaagaactaaaacagaggagtttatatagtagttcaagagtatggcaaataaggtaaccgtaccaacttcagttaatcaaaggaagattgcagaatcaattgcacaaaaaatcagcatagtcttcccttaattaagggtaattaaccaacggtaaggatatgaaatatttaaagaaagaaattcaaatcagacttaggcaaagagtgaataattaggaatctaattaaggaaataaccgtgcaaggaatcagtagatactacatgcaattaaataaggcaagaaaaccaattaaagtcgtaaacaaggaaataatcaagaatcatgcacatgaattttttaacagagcaagtcattcaacaattctggaaagaatatatcaattttcataaataaaatacgctgggtaaaactttaggaacacagagaaattagacgaaaaataattcaaaaaaccctaataaagattaattaggataaaaattacaaagcaagaaatttttactaagaaaagcgtgtaaatcagaatacaaaatgaaccaatacgactagtaactttgaaaagatcagaatcgaagcaaaacatcagacagttagagttttagcataaatcaactagggtttatgcaactttagcataaatcagtcaagaacacttaagaacaaatagttaagcattcaataataagaaaaccttttgagaagacgacttaggataaaccctggtttaggaaaaatggaaaatcagttgaaaaccagaaaacttttaaagaaaacatgtaagatatgttcgattcgtctcagatctatatagatctgagaagatcggagataaaaattagggttttcgaaagtacaacagagacgagaacataggtttagaaaatcacggattcgtaacaaaaattcttactcaaggtcgagcaaatagcctgaaacaggcaagaaatacaaatgtgcacaacagacgtgcctaggtcccttgaaatctcctcaaggatctaggagacgaataagccatagcaaataggaggccggtagaggcctgaggtgaagaagaaacaccatggaataacagtataagcctgtgacagcggggaaattagggctctgctagagagcgtttgagagagaaggggaagagtgacggcgaagggaagggggtaagtgattagggtgtgtgtgtgtgggggggggggggttggttagtttaattatggtaggaaaatcctcgtctgttgataaaaaatgatcaacgaccaggattggctaagcattgggtcgggtaggtaaatgatttgggcctaaggttttgggataatttataaagaggtgttgggctggttttttaggctaaaattgaaaataaaagggctatttattaaatatccaaaacaattgaataaaattaatttgtaaaataattaactaattataaaaataattttcatgcgtagaaatgtttaaaaaataatttttagtattttgaaatataatggactaatttctggtaaaataacccaaaaattgcatgcatgggctaaaattgcagagttattgcaattatacccaaaaggtgccaatttggctatttgtgaaataatttggacttaataggaccataaatagtaatattaaatcaagaaatattttaaaatcatttgtgattcaattttgtaattatttatataaataaaatactagagtaaattaatttaaacatataaaaattatagaaaaatatccattgatgctaatgcatagttttgaaggtatatatacactttaaaatattatagggaaaaattgggtatcaacagttataacatgttatatctttctttgttgaatttacctctgataataggctagatttatgtaatttggcgattgtttatgccccaacttaattatgtttcaatgttataatatagttaaatgatgaaaaatgggctctaattgtgaatgtcacatgttgcaggagtgaggagcttgtatgaggccttaaagctgtgattggagctacattgaagcaagaaaaaaacccttaggagctgagtacgcaagaagacgagaaaaagaatagttaaaatgaaggtttggactagcgcgaccattagcacgtccactagcgcgacactagaccagatggtcgaggcagaatgatagggcattagcgcggccattagcgcgccactagcgcggccgcgctagcccagtttcggaatattaattttcaggggtaaacttggaagtctggggaaaattcacttaaactataaaagttcaagctcgcccaaggaggggctatgcagcttttcatagattagtgcaagaaaaggggaggcaagaggcaaggaggagaattcaacatcaagttcttcctttcttccttttgttttataatttgtgatgaatttgattattgttgtgttgaacactagtatgaatagctaaatatttagtctaaggtttgatgaaacctattgaaggatgaactttttgattatgttaatataatttgccattttaatttctatttgttcaactacgtgcttgttgtagttaattgacaggatcctcaattagctatgcctatttaatgtacataactcgggagagagtgcatatttaggtaattgttgaacaacaccacgcccaaaatatatgagagatcaataattgcgggtttaaaggttggattagggataacaaagccttgggtgtaatctaaagtgagctgtaataaataaaccagctagcgtaactcttgagagtgcgtctattagattatcgtgattactcgggagagatttacggtagtaagagtgctcaggattgatagagatgatttagtgaatctatgtgaagcataaccggaagggagtccatcaatatgggaaatcatagccttagaacattctcttaatagtttacaactcaattatagttatttttcagttgcttatttacattcattcgtagttagtagaaataccctcaattgttatttacaatgtttaagaagttgattccgtggaatttagtaagtctaacgataagtaattgataggttagttccttgtggattcgactctgggcatttgcaacgtctgcgtgtcctttatataaggcatagttgggtgtgatcaaattttggcgtcgttgtcggggaatttaacggtgttatcaattacaattgaaagaagtaaaaaaaaaaatcttagtgtagtcaattttctctatacccaatctttacattgaagttttaacgtttgttgacttggttgcacaggtgcatgcctagaaactcatcgagaactggtgaagtatttgaagcattatcagatctcgagaaagttttcaaggccttgaactgggccaaccggaaaaacaaacaacaacaaacaagtgaacacttcgagacagaaatgggagatcacaaagataacccagctataccaatagcgcaagtggcacctcttgtgccagaggcagctctctatgactgggcacaacccacaactgaaaatatggccacctcgattttagtcccgcagatacaggctgaatcattccaaataatgaataacatgctgcacttgttgcagaacaagggactattttcgggatcacaagtcgaagatcctcaacatcacttgaagaatttcctgtcaatctgcaaaacccaaaggcagcccaacgtaactccggaagaaatcaagctcctattgtttccattcttagtgacaggagctgcccagacctggctaaactcactccccataaattccataacaacttgggaggagttagtcaagcaattcgtgaataagttccacgcacccaacaaaaccgctcaacaaattgatgaaattttgagttttaaacagagaccaatggaaacactgcatgaaacataggaacgattcaaggggatgctggttatatgtccgcaccatggtatttcagatctgatgttggggcagcggttttacatgggattgtcagatagtttgaagaacattgttgatgcttcaactggcagagcattttttagcaaaacatggagagaaggccagggtctgcttgacaagatggcacagaattcaggatggataaccaggaatgcacctatcactccagtggtgcactcagggcccttagatctatccaactctatggctgaaaatatggccaccttattgacacggatgagcatactcaccaaaaaggtggaagagtcagggcagaagcagcaagtgcacattgtagatactaccaatgggggtttgtgcacatcgtacattagtcatccaattcgtaaccagtggaatgcaaaacatgatcatcatcactaccctgaagacatgaactatgtgtcgaattatggaggccagatactgggtggtcagaattggggccagcagaatcagtagtacaggccagcccaaccacaattcaacaatgggaacatgggaggtatgagaccccctaacaatatggcaccttacccaaggccacaaggatataataatcaaaatcagcagcagcatgatggaaggcaggaagatgggtttgctagacttgaagcaatgatgtgtaggttattgggtctaatgcaaagattagtgagagagtagatgaacatgattcagcgatcaagaatattgaaatgcagatgggccaaattttgatgtatctgaacaatcgtcctcatgggacactacctgcagacacccagataaatccaaaaaatcaaagctcgaagcagctgatggcggtgagtctacgtaatggcagagatttggatgtagagcaagagagggatcgagaaactagacaagcggagacactcataccagtgctcattgagttggatgagtcaacgaaactgacagaagtgacagtccagcctgcccaggaagaaaataacattcagattgagaccgagaaagaagctgagacaacccaggaaccagtagttgaggtggcagctgataaaaatcaatcccaaaggattgggaagaagagaccttctgcacccttccctcagaggctggctaagtaccaaaaggaggagcaatacaagaagttcttggagatgctgaaacaaatccaggtaaatattccattaattgatgctttgaaagagatgtctaggtatgcaaaaatgatgaaggacttaatgtctcgaaaatttgatttccaagacttggccacagttagtcttacttagacctgtagtgcaatggtgactagaccaattgtggaaaagctgtctgacccagggagctttacaatttcatgcactattggtagttttgcttttgctaaggcactgtgtgatctaggggccaacattaatcttatgcccctggcgatttataagaggttgggcattgaaagagctagacctacctatatgttgttgcagctggctgataggactataaagcaaccctcaggtatcctggatgatgtgttgattcgggtagggaaatttgtgttccctgcagattttgtgatcttagactgcaaggtagatgaagagattcccataattttgggaaggacgttcttggacactaggagagctctcattgattgtgagactgtggagctcaagatgagattgaacgacgaagagataacattaaatgtgcagaaatctatgaggcaaccaagtgaattcgccaattgctctcttattgatgtcgtggatgtaattgtagagactgatgatgagatgctgactattgaggaccctcttgctgtatgtctgatgaatttagatgaggtaagtggagaagaactggcagaatgggtgatggcattagagggtagagggttctgggatggaactcttgaatttgagcccttgcacttggaaaatagagaaactcctccagccaagccatccatcgaagaaccaccaaagctggagttgaagccactgcctgcccatatcaggtacgagttccttggacctgactccacattacctgttattatctcatctagtttgttagatgtgcaggcataacaactcttacaggtactgaaggagtgtaagactgccactgggtggaccatggcagacataaaggggatcagcccagtctactgtatacacaaaattctcctagaagagggacacaaaccttccagggaacaccaaagaaggttgaaccccaacatgaaggaagtagtgaagaaagaagtgataaagtggttagatgcgggaatcattttcccaatatctgacagcagttgggttatcccgattcaatgtgtacctaaaaaggatggcatgacggtagttaaaaataataacaatgaactgctctctacgagaaccgtcacgggctagagaatttacatggattatagaaagttaaatctagacactcggaaagaccatttctcacttcccttcatttatcagatgttagacagattggcagggaggtcacatttctgtttcctggatgggtactcagggtacaatcagatctccattgcaccagagaacaaggagaagacttccttcatgtgcccgtatggcatttatgcctttaggaggatgccctttgggctatgcaatgcacccgccacattccaaaggtgcatgatggccatattcactgacatggtaaaggacataatggaggtgttcatggatgacttctccgtagtgggtaactcatttgatgagtgcctgatatagtgggtaactcatttgatgagtgcttgataaatcttactcgtgtgctgaaaatgtgtattgagactaacctggttcttaattgggagaagtgccatttcatggtacaagagggcatagtcttggggcaccgagtgtcaagcaaaggaattgaggtggatcatgctaaagtggatgtgatcgcaaagctgccccctccaacttcaatcaaggcaatcaagagcttccttaggcatgccggtttctaccggagattcataagagacttctcaaaaattgccaaccctctctgtaagttattagaaaaagatcaccctttctcattttctgataattgcagggtagcatttgaggagctgaaaaagaggttggtcacaacacctatcattgttgccctcgactgggatcagccattcgaactcatgtgtgatgccagtgactacgcagtgggggcagtgctgggaaagtggaaagacaagttgatgcatccaatctactatggtagtagaatgctgagtggatcccagctgaactacactatgactgagaaggagatgttggctgtggtgtttgctttcgacaagttcagatcatacctgattggctctaaggtaattgtatacactgatcatgcagctctcaggtacttgattgagaaggagtctaagccgtacctgattcattgggtgctactattgcaagaattcaacctcgaaattcgtgactgtaagggcacagaaaatcaagtcgctgatcatctattgcaacttgaaggagctgaaaactcaatcgaggttgaagatattctggaaatctttccagatgagcagttgctcgctactagtcttgaggaagttctatggtatgcagattatgtaaattacctggtcagcggtatagctccctatgacctttcatctgtacaaaagaaatttttttatcgtgacagtcgcatgtattattaggatgagccctatctgtttagaatatgtgttgacaatatgatccggaggtgtgtccccgagatagaacaatcttctgttttgcaggtttgtcatgcatcggtatatgaaggacattttggaagggtcaggacagctgcgaaagttctagaggccggatctttttagtcaacagtgtttaaagatgtgcaccaatgggtgaagggctgcaatgaatgtcaatggaccgggaacattttccgtaaccatgagatgcccatgaacccgattcaagaggtggaagtgtttgatgtctaggggattgacttcataggtcctttcgtcagctcctttggcaataagtacatacttgttgctgtggattacgtgtccaaatgggtagaagctgaagtgtttcccactaatgatggaagagtggtggtgggatttttgaaaaagaacatattcacccgctttggaacaccaagagcgatcattactgacggaggcacacacttctgtaatagagctttcgagaagttgctcgcaaaggatgatgtacgccacaaggtgactatcccatatcatccccaaactagtgggcaggttgaagtgtccaacagagagatcaagagtgtgctaaccaagactgtgaatgccacaagaactgattgggcgaaaaagctagatgatgcactttgggcgtatagaaccgcttttaaaacaccaattggtatgtcgccatataaattggtgtttggaaggcctgccccttgccagtggaacttgaacataaagcttggtgggcactgaaacaactgaaccttgacattgaagctgcaggcacaacgaggatcactgaattgcatgagctcgacgagtttcgacatcttgcttttgaaagcacaaggttgtacaagtaaagaatgaagtggtttcacgaccagaacattgttgagctatatttcgaacccgaggacatggtactgctctataattcaagattacggctattcccgggtaagcataaatcacgatggtctgggccatttcgattggttgaagtattcccttcaggagctgtagagatcgcctaagagaaagactctcacacatttagagtcaatgggcagagattaaagttatacataggcatgaaggaaccaaaggaagtgtcagaggtccacctaatggaacctcagaggtcgagcgagccttaaatgcgtttgtctgcgtcgtgccacgatattaactaaggcgctggttgggaggcaacccaacgatagtagtagttgttaattgtgagttttaggaagtgctaaccaatgcaggtgacaatgggcgggtgataaagccatcgaaagtggtaacaacaagtggaaaatgtaaaaaaaattcctcccaagagcgcgcccgcgctataggctgtgctatttgggcaaacattctacccggcccgcgctaataggcaaacattctgcctggcctgtgctcgtgaacgtgctcctggatgcgctactagcgctatcgcgctcctagacgcgttagttccgacgattttttttgtgttatattttctgagttgttgtaattttattttttttgttagttgtaataaacccctcctttaatcccccaatcccacgccccactcccaattcccatgccccgattccaaacacaagagaaagagaaacaaaaccctccccaaatcctcttcttcatcaaatccccttcaccttcaactcccctcttccacaaatttttattttttttcaattggccccaagtctccaaccacattctcctccacctttcttctctgttcccctccttctatcactacaggtatgcattttagggaccatttttttttcttttgttccttttatttctgattttcatttttatttttattattgttgctcttgcctctgtttagtcgaaatttgtagtatttgttgtagtaactatggatggaatggtcggtggagttagagaatgatttagttgtgcttgtggctacattgtggtggtttttgatgttgtcaaatacttgaaaagggttgtgagtgcctaatgcccacaaggtctttgtggaaaggcctcaatgaacgtaactatgtagttgtgaccacttatgcatgtgaagtctgagtaatcgcaatgcgtcacaattttgtgttgggctgtgctaatgtgttcccgtttttcaggtatactgactccatctaggaaacgccgcgccacaggtgcatcttctagcagccaagccgactcgtccaggacacgaggagcagcccctacatgcccctttgatagcaccagatttgtctcggccaaggcttaggaccactttgcggcgaaggcctctaaaaaaccgattccggagaggggtaataacatcggattagtccagcagcactgccctcacatttacactgagatgttgaggcgggggttgaaaaccttcattaatgagccatgtgagggcaattttatggttgttagagaattttacgccaatgtgttggagcatgacaatggtgtagtcatggtgcaccgaaaggtggtgaatgcttctattgaggcgatacggacgacataccagttgccccatgttgtggttgattataatgacttttatgagtatgaccgtaacccaacacacgaaaagtgggagcgattctttgaaacaatctgtgtaccaaggaaggaggtggtttggatgaaatatggtgagaagtttcactcctcggcactaacctttgaaggaaagtgctagctgtatcttatcaacaaccgtctgctttcgtcctccaacactactgaggtaaatgggccccaggcaactttgatttggtgcttcgtcaatggtcacaacttcgacgtggccaaagtgatacatgaagagatgttcatacgctacctagtaaaaaggtataggttcttttcccttcttttgttactcagctttgcagggaagctcgggtgcccaaaaatctagctgtggatgggctagtaccaagagaccacaagttctgggctgacaaggtaacaacgggtaaggagccggcggcagtttagggggaggataatagtggctctgatgactcggacgaagaggaggacgaacaggaggatgtggaggccgaaccacaggcccatgagcacagtgcagcagctgcagcaccacctaggacttcaacatcctcccagccacgccgtagtacccgtatgaccgctttagagcaggatatggctgggttgcgtacctccatcactgatttaggtgcccgcgttgacgcgatggctgagcggtaggtgaagtcagaaaagaaattcttaggctggcagagagctctgggtcgcacatgcaatgtgaacccagacaccgtctccgagcaggagtgatcctttagggaagttcctttaccttactactctttaaattttggtgccatgaggacatgtctacattttaagtgtggggtgggggatacttcaatgtatatatgtaattgtacaatttaactgtttgatgtctctttgttttgcgttgattgttttcgatgtttgagtaatagtttcattaggttagtttaaagtaggtaagtggcttgttccgacaacggatctctttcggcgggattcttgagggactaagtcgattgaaaaaaaaaaggaaatatggagactcttcctgatgatgaagcctttagacaattttcttgagggaagtaagtctagagaaaagaccaaaaagattttttttaggtagtgtagtaaccccccattgggttttctttgggccacggttctttttcaagggtttaacttgaattgggtataggtagtttttgttcattttgttttctttttagtagattaggattaataggctacgagctaaaatcgaaagttaagcctctagcgttgatacacctgaacacaatagacactagagtgtaacacttagtctcagtagttgattcttgctaaagtgccttaaaaattgtatgtttgttactgaattgaatactcagaagagagtgtcttgataagccaatctggaataagtcatgtgccatgtgcgtgtcagttttattgtattccatgattcacatttgatgcctagaacttgccttgtgtgtttgcaaagcgaaatagtagtttcattcagtcctagaagtgatataggcatttctttattgagccagacatataaagtaaacctacctaactgtattacatcttagttaaccccattgagcctataaacctatttctttggcaaccacattgcgaaccttacccaattatttgaatagcctgctgtttgaacccttctacctcccataagcacttgaatggtatggaaattatacaaaggcaaaagtgtggggtggttctttggtttttgagtggagccgttgaaatagataaaaggtgcagtgtttggaaaagtaaaagaataagcaccactgaaaaaaatgaataaatgtagtaatcgataagtggtggtttgttataattacatccaatggatggggttgttgtaaataaaagaaaaaaaaatggtgggatatttggttgacataagtatggctttgaatgttaatgtaattgtattaaaaagtgcttagggaggttagtcactatatccacatatatcctacccgtcccttagcctacattacaaccaagtgaagacctattgatcttatactgagcgggctcgattagtagagtagtacactacgggcaagcctatggtgcatctttatggcatgtgaatgttcttttttgagagtgagctagttttgtctatctaagttcctaattgttctaaacatcactatatgtggaactactctcttgtgtggtgcgggcatgtaattcatgaaggaagggcaagtcttgacttttgcgtagagtagtttgagaaagtatgaatattgcacgacacgtgagagtcgacttttgaggctaagattgttcactactaggtgtaactcatgtgatttgttcttggtgtgatgcgttaaggaagaattcttagtgaaggaacctctatagagtgtggtggactgctcgaggactagcaatgatttaagtgtggggtgttgataatagactagatttatgtaatttggcgattgtttatgccccaacttaattatgtttcaatgttataatatagttaaatgatgaaaaatgggctctaattgtgaatgtcacacattgtaggagtgaggagcttgtatgaggccttaaagatgtgattggagctacattgaagcaagaaaaaaccccctaggagctgagtacgcaagaagacgagaaaaagaatagttaaaatgaaggcctagactagcgcgaccattagcgcggccgcgctagaccagatggtcgaggcagaatgatagggcattagcgcggccattagcgcggccgcgctagcctagttccggaatattaattttcaggggtaaacttggaagtctgggggaaaaaatcacttaacctatagaaggtcaagcttgcccaaggaggggctatgcaacttttcatagcttagtgcaagaaaaggagaggcaagaggcaaggaggagaattcaacatcaagttcttcctttcttccttttgttttatgatttgtgatgaatttgattattgttgtgatgaacactagtatgaatagctaaatacttagtctaaggtttgatggaacctattgaaggatgaacttcttgcttatgttaatatagtttgccattttaatctctatttgttcaactacgtgcttattgtagttaattgacaggatcctcaattagctgtgcctatttaatgtgcataattcgggagagagtgcatatttaggtaattattgaacaccaccactcccaaaatatatgagggatcaataattgcggatttaaaggctggattagggataacgaagccttgggtgtaatctaaagtgagctgtaataaataaactagctagcgtaactcgggagagtgcatctagtagattatcgtgattactcgggagagatttacagtagtaagagtgcttaggattgatagagataatttggtaaatctatgtgaagcataaccggaagagagtctatcaatagggaaaatcatagccttagaaccttctcttaatagtttacaactcaattatagttatttttcagttgcttatttacattcattcgtagttagtaaaaataccctcaattgttatttacaacatttgagaagttgattccgtggaatttagtaagtctaacgagaagtaattaataggttaattccttgtgggttcgactctgggctaaatactcagattatatttgcaacgtatgtgtgtcctttacataaggcatagttgggtgtgatcaacctcacatgctataattgatttgttagtccatgttctatcttttattgccaaatttacccttatatactttaattgaaattgttgcttctttcattgtcacgttatctcttccataaatgatttattcttatttgaagtcgttgctacatgttatctatctcattgttgagttattattatttgaatttattattacttgttatgtctttcattgttgagcttattctcccatttcattgtgttgtcataattctcgtgttaatttacttgccgtactctcgtgttattgttgtactcagtgttgttgagtcgtgggctatgtgtggttgtgatattgagattgttgttatggaaatgttgcggcatatgggtacatgtagtgtgagttattatattgcgttgttatgttttagacacatgtcaaattgtttagaggattgtcggggtgtttgcatgtgagttgttcgtgctattgttattattgatattttcacatgcggtgtgataaggcgggctatatatgttgagtttgcgcatgtagggcatgataattattgatgcgcgtgtggcgagacaaggcgggcatttactttactattgtgcatgcaacgagacaaggcgagctatatcatggatgatttgtgatggcctgggggcattgtctttgatgatatttgtgtggtggtttgaccatattgtgtgcatcatgcatattgtgggtttttttgtattgtttccaatgtgctattcgatatctttgatcttacttattgactcgagatgtgatagtacacctgcacaagcatatatcgtaatctgtcacctatatcagtccatgagtataattctcgatgtttattgatcatgtacatgtattcttgtatatctaccttatatgtggggactgaactgttggcatgtaggttgtctgtgttgatataagacattgttactattgacacgtgagttgtccgtgcggatatgagtttattgttaatagaattagcacgtcagtaatccatgcgggtatggggttactgttaatagaattagcatgttagttatgcgtgtaacatgtagattgtccgtgcaattgtgctttataaagtgggcaagagatgtcgcgtgattatgattcgtgagttgggatttgtgaaattgtggtatttcgatatgatccttgttgtgcattttatgttgaaaagctcgatgagttgaatgattgtggttcttgttttccttacttccttccattcgtattttttcattgttagattatatcaatgtcttgtacatgttttcatgtctagtaggtgtcttgacatgacctcgtcactactctaccgatattaggcttgatacttattggataccgatgtggtgtactcatgctatggttgctgcacatttttttgtagatcaagtaccttggagtatgcaggttgttggttagttgattgtgagctgatgtggagacttcaaggtatacaggccatcccgttcgcaagcctcgaagtcactttctgttgttttctttaccactatttatttctatttcagaatagtttgtacttggagattcttctaatgaattcaatagagcttatgacttgtactactgattttgggatattgaacatctattgatggttgtaggctatgtatagaaatttatggttcatgtttaatagttgattgctttaaatctattaatatctcgatatgtgttaggcttacctagtcttagagactaggtgccatcaatattagaagggatattgggtcgtgacaaaaagtaaatctctcatgtataataaaaaagagataaggtcataaaacaaaaaacaaagtaattatctcatgtgtaaaaaaagagatggagtcataaaactaaaaacaagtttataaagacccacaacatcatttgatccttatttgatccttagagttgttaattcataaagttatattaatgtcaatgaaagttggttgggctatttgtaacatgtgggttaaagattatgacatatattactagtgcaattatgaatacatgggattggttaccttgaaatacatatacaacacagcttgcatagttgcaagaatattagcggtggtttggtaggatgcactagagaaaataatgcatgcattagcttttggtattactaatttgttgtttgatacactttttcagcctatgtattactaatgcaagtattagatatataacatatttggtattatcctatgtaaaactaatacatagcaaaccatggtattagcaataccaaagctattaatgaatgcattagcatggttaaagataaaattgtccttataatccttcaaagctgaataatacggaggacattttggtatataactaatttttaaaaaaaattatgcaatgcattcttgaagtggaggttagcgtcgggagtcttgtgtgacaagaaagtgtcaccgttactaaaaggtaagttttatacggcagtggttaggcctgccatgttatatggaactgaatgttggccggtaaagaactcacacatccagaagatgaaagtagcagagatgaggatgttgaggtggatgtgcgggcatacaaggatggataagattaggaatgaagatattcgagagaaggtgggcgtggcccccatggaggacaagatgcgggaagtaagactcagatggttcgggcacattcagaggaggagcactgatgcaccggtgaggaggtgtgagcgactggctgtggtgggcacgcggagaggtagatggcgacctaagaagtattggggagaggtgatcagacaggacatgactcgacttaggattactgaggacatgacccttgacagggaattatggaggtcgagcattaaggttgtaggttaggggaaagttgtgaatatttttacagcacaatagagtgagactagccagttaggagttagactaagaatgtcattggtcgtctattgatgcagggctttacctgctagttttactataccagccatctatttcgtatttcatattttgtatttcatatctcttatattgctgttattttattatgcatttttatggtactaatatatcggctcatgttgcttttttgagccgagggtctcctggaaacagcctctctacccttcggggtaggggtaaggtctgcgtacatattaccctccccagaccccacttgtgggattatactggatcgttgttgttgttgttattgttgttgttgttgttgttgttgttgttgttgttgttgttgttgttgttgttgtatgcaatgcattctaattttcaatacactactccaaacactagataagaagtaatctttgcataactaatatgttatttgaattggcttttaaaaagtagcttataagctaaaagccataagttggtaatacctaacatttaacttttggcttatttttgtatatttcatgtctaaaagtaagtgcttttcagcactttttatcattgccaaataacacaaaaactaaaaaagtgcttaaaagccaataaacacttaaaataagccaatccaaataccatttaatacttgcattactaatccctacattactaatataacttattcaaaattatttttatacaccctaccaaacgaccccttattgtaacacttcatattttactattttagggatcctatatgcaccacttttatagttagagaactatttagagtacctcagtatactttagggatcacttggaataaatgctaaaacttaagggaccattctagacttttttctcgacgacgacaacgccagtaaagaaatgtatataataaataaataaataaataaaaagcacaacatgtacgataagtccgggatttttccagattaggttctctaactcctctctctctctcacacactcactctccctccctcgtgtactacactcagcattggggctagggtttcaccaaatatctttttcacaaattatcttagggtttttgtctgttcttcacaactgatttatgataatggatatacggatgaattaagctttttcgagggattttagacttataaaaaactaaagggttttttgtaattgttgcttgaaatggcggatttgaacccatttgatttgctgggtgatgatgacaacgatgacccatctaagctgattgccattcagcagcaaaaagttgataccgctaagaaaccctctgctccggcggcggcggctaagaagcagccggctaagctccccactaagcctcctcccacggctcaggctggtgagcgtcacctcagtttattatgttctcatattttgtatattacctaaaagtagagaaaggtattagtatttcgatcatgtttagtgtattgagttaagcagatattccatattgcgcagatagcgtgattaactttttggatgttgatttcaacgtctaatcaattaatatgacaccaacttggtgtattgcttatgcaatactaacattgatttatcaaaacggaagtagtcatgacgtacatagacctttaaatataacagtctatacgtgtgacaccatagtgattagaagtgctaaaagggactaggtttatttaaaatcacacgaggaattgtctagaagaaactccattctcttaggattgatgtgggctcaactaagagtatgagagaatcgaagcaaagtactcgcgcagatgataccagctatttaagattcatgcttagttgttgttgttgttcacacctacattaggtcgaggtaaggataagtgtgatagaatctctaattttccttcaattacttagcagtatcagcatgaaattgggttgaatacagtggaatatatagaggattcatgtcattaacccgaactattttgggattgaggtattgacccaaaaagaaaaggaactagtttgagaatgaggcataatttattgatataagaaagaaaatataatgagttaaatactccaattttaagagggaagcataagattttgtaatttggacctttatttattgaaggattggctgttgtgtcctatttctagtgtcacttcaaaagaatgagaaataatcccattcctgctgttattgattcctcttggtcttgaaatttcagttgttcatcatacgtacatacttttttatattccacacaagatgtctgacggtgaccagttctctgttattctatttccttattctcataatttttgctagtgggtccacttgaataatgatatggatgaattactttttgtttatatcttttgttatagtcattgcacttatggttcttttcctctttttcttttgcaagtattcagaatttacttattgcttctttgtttcaactgtgtagtcagggaggcaaaaacagaggttggacgtggaggaggtagaggtggtggacgtggttacagtcgtggtcgtggtggaggcgggtttaatagggaagcatccaacaatgagaatttttctcgaaacagagaattttctggtggtatagctgcacctgaagatgtggaaggaggaagaccctatgaaagacgtggcggttacggtggaccccatgcttttggtggtggtcgacgaggcggttttagtaatgaagaatttcctgagggagaccggcctcgtaggatatttgagcgccgtagtggtactggccgcgggtagacacacctttcttgtctgtgttaccatcaccttttgttgctgtatttgtaaagctttcttacttttccttcgctatacgagcagaggtgagataaagcgtgaaggagctggccgaggaaattggggaactcaagcagatgaagttactcagtgagttttaccttcctacatagtcctaaacagactagtgtgaacatcatggcacattctatctattgattatggtgttgatttgtttgtgttgtgtattataggattactgatgaagttgctaatgaaggcgagaaaaatctgaatgtggagaaaccctccgcagatggagaagcaggagacgacaagaaggaaaatccagctgctgaagctgaggacaaggaacctgaaaataaggtgaaccttttgtatcatactcaacacattattgataggaccttgacgatccctgtgttgctgccttgtttgttgacacatgtcctgctctgctctagaaacagatgcttaagagagcttgagcagtcagaatttaacaccttcctttttgatggcttcgtgctcaattggagtatgctaaatcaattgggtgtttagtatatgctatgacatgcacttcaccaacattgctgatgcagttgctctttaattaaaagaaggtttctgaattgacatggtttttgcttcatatattgtttcacttaatttcaattattttatctatatattgttgtttgtttttataatataaaaattataatgctcacctgtgctattagttattttttctgcagtactgtatatattaaattcttttcccttcgaacatacatgccttcgctgcagagtaggtgttttagttgcactttactttatgtatttcgcttcttacaatattgaccgtaaaggtagaagcagaggtttcatcagtagtagaagctttccaggtgttgttctagctgtggtagaactagtacttaatacatagtggagttgcaggcgatagttaataggtgttacatgtgaatgtaactcatgttccttgaatgaataggagatgacccttgaagagtacgagaaggtgctagaagaaaagcggcaggctttgcaggcacttaaaactgaggaaaggaaggtcgacatcaaagaatttgaatccatgcaacagctttcaaagaaatccagtgatgacatcttcatcaaattggtgaaattcttgagacattatgccctctactcatgcttgatgctagttatctataaagcatctcttgaaatacttctatgccatgatttttagggccccaaggataagagaagagagtctgctgagaaggaagagaaggcaaagaaggtacttattcggcatatgcgttctttcctgacaattgtttaaccagcaaatgcttttcatacactgctcaatagtgatttaccaagctttatgaacaatgcgtccagtctgttgcaattgttatatgaacaatgcttccaatctgttctagttgttattcttgctatacaccacagcagttatttctacttttctggatgctgttgcatgtgtgtcgatgaaaatggtatcatgtaacaacattgttgtagagggaatatttaagttgtatttcttctaaagtcgggccttggtttctttcagattttctggtaattgtttgacttgcgaacatatagtaattattgtagtaccatgctacaatttttacaataaaattccattgctcactcttatacatgtgcatggacaggctggagttgattgagatgagaggtgtcaaatcagcagaaatgagaatcatctaatctttttttcccttcttctctggctttaggcagtcagcattaatgagtttctgaagcctgctgagggtgagaggtattatgcacctggtggtcgaggtcgaggaggtcgtggccgtggttctagaggttatggtggaggttacggtggagccaacactaccagcaacgtggaagcccctctcattgaagatccgggtcacttccctacattgggtggcaagtgatgctttattagtgcttttctcccacgtccaagaggcaaattgactgaaaaataatggagtgaaagggtcaatgtttctgatggccttcaatgtaaatttcttgccctcatgcagtacccctctgtagtttttttctttatgttgtgttacttttctgatatattggggtatatgaagcacattaatttatgcatgagctttttctccgcagttccgttcttatattttgtatcgcattctcattgacaaaagatgggagggtgctcgtgttctgatttgggacaaaacacctttacaatttacattatttgtgttgggaagtgataaaagtttaatagccgtgacactaatgagtaaccgtaggggggacggttagtgcaaatccgtggtgaggttatttgacttctcatgttttgtccatactctatattttttttcaaaaaatctgatcaccctggccttcacctcctgtggtgttgaagcgtttggcattgaccctttttgcttattagaatcaaaaaaagattccaataagaaggggaccttatatgtgttcgaaactgaccaaagctctgatagcaccaaagagtttataagttcatcctcttaatgaatcttaggaattgctaaaaaaaggaattaatcacttgtccttttcatctaatgaagtgttcacgctatttcctttacaaggtccaatgttctatacacttcatggacctgctctgccggtcttccaccattctgcgacactactttggcaaaaagaaaagattgtatactaggctcaacagaagcaacaaagtgaagagaaagagcgcgaacaccttcattatgagaagcaacgtgactaactattttggcccgttaatttcttcatatgcataactagaacaatttggatcgtgtactcctataacatagtaaaaaaaaaaaggtgttctggtaaggcggtataaggcaattgtatgttctctatccctataagcatagattgccatattctcgctagagtgcaaaacaaattagcttaggcgctaacacgctgttctcatactgttgaaatatgagaaatatatttagacatatattgagaagaggatcatgccgaccgagcagacctttgagcttagcacatttttgtggcaggcgaagtgctgtccctttggggacatccgatgacaaaaaggatcttagtcaccagacgtttgagtgcgtattcatcttcgccagtatagcttcatgttgaactatgagaaatatattaagatatttgtcaagctgaagcagggctaagttgtcaaagttcaacaatcgttatgttcacaatttgtacacttcaattaaaaaatctttttaatcaagaaaaaagaagatacatctagctgtaaggattttgcaggacaagtccacaagggtaaacattgcttgtgattagtgagattacagtagatatgtcatggatgagccatcaagcaaatagcggaggttctcttgtagtcaaaggactcaagatgagcagcagccactattctgagcaacaggctgtccacgaatatttacagttggaggcttggcagtacttgtggctggttggcttgccatactgcaataaggagagcaaaagagaattgaaataatggaattttgcttgttaagaatgaaattatggaaatttagagaagcaacgcatatgccagctcaaatcataaatgtaaatgaaaagattatttggaggacattttatacaagggatgaggccagaaccaaacaagttgctgtatctttcatttagattttttttttttggcttgtgaaaatgttatagggggttgcacgaaatgatccatgaccatgtttaaatccattttaaggcatcaaataggatcctaactgtaagatgattatgtttaccatctgaaatatctctcaattttctgtaccaaccataatgtcagaaaaggaagtgataaaaatatatacgtatccctctcccagaaaattttagtaattgaatctgatgaaagatcaggccacaacttggaaaggctatacaagacaccattgaggagcactatttaaagaggatacacttttacctattcttgatagcagaagtcatagccatgaaagcctgttctacgttactagcatctttcgcactggtctccaagaatggaatcccaatttcatcagcaaaggcctaagaataaatttaagtagatcagtttgttttacatttaaggacaaaggataattaaatatctgcacgaagatgattcaccttagccgtttcatacgacacaactctattagctgcaaggtcagacttgttcccgacaagaatcttgttaacatttggggtagcataacgatcaatttcattcagccactgcttcacattattgaagctctcctgatccgtcacatcatagacaatctaccatagaggccatgcaaagaaaatgtcaaaaggtacagaaagcagttggcattagactctacagataactacttgctatttacaatttcttataaaaagtaaggcaactactcactattatgccatgggctccacgatagtagctgctagtgatagtcctaaaacgctcttgtccagcagtatcccactaaacagtgtcaaaatagaaaacaacaatatcttgatttcatgaaaagttcacaacacaacgaatatctgtaatatgaaaggcctgaagcagaagtgcaggtgaagtcttacaatctgaagcttaatggtcttcccatcttgctccactgtccggattttctacatgaaaatatttgaacagttggtaagatcagtgataacataaaagtaagagtgctctggctgaaaaagatcacataagattccaactgtatgtaaaattgagtagctcataaacaattaaagcatcttacaaaatcaactccaattgtgcttatgtagctctcctgatatgtgtcatcctgatggtaaaaagcgataaaatagtcagccaacatttgcagaataaattttttaaccacattgaactataatctgataaacttttcagcagggtgagaatctctgagttgaactataatctaataaacttttcaggaggttgagaatctctgagttcacgatcaagaatctctaacaatgaaagcgacgcaaccagaaataagttcataactaatcatccagatgattaaagtgtgaaaaataaatttcgtgtaaaagaagagtctcaaatatcatggcagatgtagctttttatgagtaggtgattcataatttcataaaaagcaatacaacaactccaccagggtcagtagactctactagctggaaaattaaggattattcaagacaaataattcactccaagtggagaatggaactgagaaatgaagacatggagaatccatggctgatgctccataaatcctccatttgtttagtcaatcaggaatttagtaggtacgttcagacaggtaaaagcaggactagagaaaaaagtcagtatagacaattccaagatttgaaaacttacagcaaatcttaaaaggagacatgacttcccaacaccagaatcaccgataagcagaagcttgaacaggtagtcactgccggaaagcacaaccaatataattataatatacatccattagctggcaaatgtgcaaagttgtatacttaagcgctacccggaatgaaaaaactaaatcactaatagaaacaagcgctaacatcaatatgagagaagtttgttaccttgctatatatgcgtaatttagcaacatctactggtcacattgggattaaatttggtagtcctacttgatttggctataaaaatatggaagggcagaagttctacatttacgtattattccctagatgttcaaacttactatactttttagtaaatattatttcacatatttatcaacacaccaagacaaagtagtctttacattatagaaatcatcatgcactgttggatgatgcagtctaagtatggttagattgatatgtatgatagaatttgcggaagagattgtctaaggattgtacctcatttgataggctaaaatgatagacatgagataattgacctgccatatgctatcatctacaatcaaatatagcctacaagttccaacattgattatgtttggagtaaatattttgcatcttcttgatgccattattgaagtcaattacttcataaaaaacacagatcatgtttggatgctcttttctaggttgcacttgatatgatttaatgctgcatcacgaacacgtaatcctagttatctagaacatctctacaccaaaggaagaccaacaaatatcggcctatttacccaaaaaaaactgacttaggaggttactagttggaccttgtgcaagcatgtgaaagaaatattacaccaaggaatttcaaacgatctgagataaccatgaaagcaatgttgtcaatgacaaaaaataggaagtgccaagtgcctacaggaatttaacagcaaaccacaactgaagtgcgcactttatgaagaaaggcgcgtatgaaaataaggtatatgcaaggcaagaaaaaaaatagtagttgtaaatgttaatcaacaactgcaattatatagacttactgaaaaagctgcaattgagtgaattgtatgaagcaagaaccttcttcatcaagttcaaaaaccatttaaaatctctaatttaaatataaaagatacagttttgagttttgaatttaactggtgactagtatttttaatactttttaagtttccaatttaccatttcctgaaaataacttctattttttgggaccgattgaaaaaggaataagttattaagcttaatgttgattttaatcttctcaaacgacgttcgattgctgattttagtgaattagggattataggtgaaatccacaactgcgataaagataaggatgttttgacaaaatccacagttaaacgaataagtattgaaacgaaaagaactagaaaaggaaattgaatgacagaaactaatatgaagagatagttcaattcttcaccaataagtattgcaaaataagcaaaggaatatgccgacggaacttactattctggattcatggagactaaaagcagacggaagtcgccggaatattgagagatctaccggcgagaattggacggaatttgattcttcgcggcagaattcagatgcaaaaacgttgaaagaggctgtgggagagagaaagagaccctgcaatgaagacacgtaaaaggaaacaatgacaaaaatggtcctttatgtttgggaaggtctaaagtagtcccttaaatatacatttaaatagttttagttctttaaatttatcaaaatcgagcaattttggcctctattaaatatttaacaaactacggtagttaaattaatgggaaccggaaaaaacatttgaaggtgcatattttgaagtttttgctatttttgtctatttctaatgtcgggtgcagtttttgaggttatttagttcgggtctttaatattagaattaggggtgtataaaggaaaacgataaattgtactaaatcgataatccgagttaaaccgaaaaaaatccgactatggtttgatattaggaaaaaatccaaccataattggtttagtgttaggaaaacaaaccaaccataattggtttggtttggttttaactaaaaaaagtcaaaccgaaaccaaaccaatctgacattatatgtatacaagttttaaaaatacttttataataaaaataattattgtaatgtaatttataaatattttttaactctttaatagttctctcttttaatgttttatttcaagcttgggtttagaacttttgaatggtcaaatatgttttataactcataaaagctagtaactcaaataaagcccaaagcaaaatcaaatcaatactaatgctaacaaaaaaatttcaattcaatactaggaataacgataatactggatatttatttttttagttttgcattgacttagatagtgaaaatgcataacctacttttaatattatttagtcatataattaatggggtagtacttattagtcgtacttattttaacatgatttagtactttagattatttttttatttttattatggcttattaattagcaatatctatcttatacgatttgttgagtattttagtataatcatgactcatcttatattattttatattattttagcaatatctatcttatacgatttgttgagtattttagtataatcatgactcatcttatattattttattggatagtatcttatatagtttgatcctactaggacctaagaaatattacagcacaaattataaattttatgttatgaagattttgtcggaaaaaatcccgaaaaaacccgaaaaatccgagaaaaaccgcgattggaaaatccaacttttgttggtttggtttggtttatagatttaaaaattcgagacaattggtttggtttgataattaaaaaatccgaaccaacccggcctatatacacccctaattaaaatatttgatattccaatttctgatgtataattgtaatattttggtgtttcttgttaaaaaaaattcttccaatatcaattaaatctaacaactagacaaaaaccaaacgtgcttacttttgacaaacttggtaaggggccatttttgttatttctctaaaagaaagcattgattattttctcatcccgcttattattttaataaaataataagtcatatcatgagcatgaaatcgagttgttaatagataaaagacaaaatcaacttttaagccaaatattgatgacaatatgaaatttactgatacgctagctacaacaacaacaacaacaacaacccagtgtaatcacacaagtggggtctggggagggtaatatgtacgcagaccttacctctacccgagaggcagagaggctgtttccaggagaccctcggctcaaagaggcaacaagagacactatattagtactatcaatagactcataataaaacaacataaaataccatgaaatccataacataacataaatgccatataaaacaaagtaacagcaatataagagatataggaaatacgagaaagatataaggtattaatacacaacagataaagcccatcatcagtagttgatcaatagcatcctaagactaactcctaactggctagtctcactctagtgcgctgtaaaaaagacatcacaatttcccctaacctacaaccttaatgctcgatctccacaattccctatttagggccatatcctcagtaaccctaagtcgcgccatatcttgcttcatcacctctccccaatacttcttaggtctccctctacctctcttcgtacccaccacctccagtcgttcacaccttctcagcggtgcatcagtgttcctcctctgaatgtgcccgaaccatctgagtcttgcttcccgcatcttgtcctccatgggggccacacccacctctcttgaatatcttcatttctaatcttatccctccttgtatgcccgcacatccacctcaacatcctcatctctgcaactttcatcctctggatgtgtgagatcttcaccggccaacactcggtcccatacaacatagcaagcctaaccactgccctataaaatttacctttcagtaaaagtggcactttcttgtcacacaggactcccgacgctaacctccatttcatccaccccacccctatacggtgtgtgacatcctcgtcgatctccccggacccctgaataaacgaccccaggtacttgaaactacccctcttagggatgacttgagaatcaagcctcacttccactcccgcttccgtcggctttgccccaaatttgcactcaaggtattccgtcttcgtcctgctcaacctgaaacctttggactcaagggtatgtctccaaacctctaacctctcgctgacgccgcgtcgtgtctcgtcgattaggactatgtcatcagcaaatagcatgcaccatggcacctccccttgaatatgatgtgttatagcatccatcaccagggcaaataggaaagggctgaacgcagacccttggtgcaaccccgtaataaccggaaaataatcggaatcgcctcctgctgtcctaacccgagtcttagctccatcatacatgtccttaatcgccctaatgtaggcaaccagtacccctttagcctctaagcatctccataagacctccctaggaaccctgtcgtacgcttttagatcgataaacaccatgtggagatccttcttcttatccctgtattgttccaccatcctcctaataaggtggatagcttctgtggtagatcgccccggcatgaacccggactggttgtctgaaatagacaccgtccttcgcactctcatttctaccactttctcccaaactttcatggtatgacttagtaatttaatacccctatagttgttacagatctggatatcgcctttgttcttatacaacgggaccattgtactccacctccactcttcgggcatcctattagtcttggatataacattaagcaacttagtaagccattccaaacctgctctacccacacacctccaaagctcaaccagaatttcatctggtccggtagctctgccccttctcatcttatgcattgcctccataacctcatcgacctcaatgtcccgacaatcacttagttcatgggggctgtcagcgttcctcaattcacctagtataatatcctgatccccttcctcatttagaagtttatgaaagtagatctgccatctcctcttaatctggtcatcccccaacaaaactttgtcgtcctcatcttttatgcacctcacttggtccaaatcccgagccgtcctctctctcaccttagcgagtcggagtaacttcttctccccgccttttttggtaactaacttctttttattagttaccaaatagtaattacataacaaagcaaagcaaacacagcttgctaatcttttatttactccttatactaatcttcctagaaacataaactatacacataatgcttgttcctaggagtgactctagcactaactatatatgctatatcttttgaaatttgctccacatttctgctcttcttctcgaatacgcttctgtttctttcaagtcatatatgataaacaacttctgcatacattattctgaacatcatcgcataaacagacttcccttttgcttcaattatggcccattgaagaaactgctgccagttgccatttccaaacttctattttccaagccatctgcacattctgttccacacttggattgcataatcacaatgccagaataggtgatctcttgtttccttttcttttatacacatcacacaatctggttctacattgaccttccaactaactaacctgtcacaggtcattagcctttcctggatcatcaaccacataatgaattttgcttttggtcttgctgcattttgaaataccaatgttttccattccgttcttctgtaatcttccagtaggtgcaggtatatttgtctgatcatgctcttcttccgactatgtgagaactgcacctcttcaagtatactgtatgactcaatcactttccttaccatccagcatgcttgttgaggaactttcattgtcttcacttgctgattcttgacataataagcatgtatccatctgatccatagcttgtcctatttgtgagctaaatcccagcatgtctttgcaatagttgccttgttccacaacttcaaattgattcaccaatttgaagaacgcaattcttaatattaatatataattcaccaacatgtactttgttttcccagtatttgttgggaaatgtcattaatccactatcagatacataaatttaatttaaggatttaagttatatgtattgacagtataacgatttttttcaccaaatataacttaacctgtcataggcagctaatggtggggaactctgtggttttgtttccatttcaccaatttatgggatgatatttctccagataacttttccttctactctttcagctctcatcgaagtttgagaacctaacatgtctaagattgtttgatacaataagaactctgaagttcatgaagcttgagaatttagtgtaaacagtccaggataaaggaagactagttttttttttgggaaaatttgatcaccaagacacaaaataagagagggtgaaaataatttgttttatttcacaagttggcccgaatactacaattatcaggaaaaatacgcgtgtcaaagattaggtctcaggttcaaattctagcgaagacaaaaatactaggtgatttcttctcatctatctaagccttggtggatagagttatcaggtatctattactagtgggaggtaccacgtacctgtagaattaattgaagtgagagcaagcttgccagtacaccacgattataaaaaaaataccggtgtcaaggttagggtctcatgtttaaattctataggaggcaaaaatatttggtgatttttccccatatgtccacgacttattgaacatagttactcaatatatgtactggcgagaggtagaaggtgcgctgttgatgcccaatttcgccatcatatttttccaaataatatatatttttaacatgtcagctttgcgtcattatttagtttataagaattatacatgtatttttcataatttttagcaaattttacagctttaaagataattttcttgcatctaaattacttaaatatttactaattattcctttaaattattttttgatgacttgatcatctaaaattattatttgcatctatatacatgtttcaaaattttcttttaattcattttatataattatattagtatttttaggctatttgcacaatcttgcaataatagcccatattttgcattttattgcacttgtcattttattcagggtcaaaataagtctctacatttttataatcttctactattttaaagtagtaatttgcatatatatcttttttatatttatttaactatttttattaaattattttccttttaatctcttatttaaaagctgggccaaattttgagctaattttcggaccaaacgaacctaaatccctggaccaatccccaagaccctttaaaataacccgccctgtttcttttgcgatcctggccgttgttctcaaatgatcaacgacctatcataaacccatccgttccttttatattgcctcttacccaaaaccctagcccattttctaccaatcgccgcccctgaaatccctggaatccacccttttctctgaagaaccctaatcaccgccctctccaatccttctcataattccgttaacaatgggattcaccaattattttcttactatatttgcattccttcgctactaggtgttttttatggtattacatagtactttctttattttggaaagtataaatctttaaataaaagggaatccttctttaatcttcaagatctagacggtatttcgtccatatgcatcatgacaaggtcatatgggttcgaatcaatgagatttttaactatttttggctctccatcataaactagggtttacctaattttctccctaatccgtttttaattgattccgcatgttattatttccttatttgtgtttgattttacagtgtttccttgtttgtttgcttgatttctactactatataaatccttcccctatttccctttgagggcagactttaatcatcggattcactaaaaactcaaagctatcactctattattatctcactctcttgttctatactttagctcttggccggctaaaagccaaggttaccggaatttgattattcaacctttcttagtgcaagcactgtcaggagttcatttgaaacccttggaaactctgatgcactaagactctgggttctattgctctttgttgacgtttagaatactgtagagtttgttatttcttgcttgtctgtttatcaattgataactggtaagttccttcgcttttgcaattttattctcttgtattcatgtcttgtacattcatacctctgaaattccgtgacttgatgtattactaggacatctccgtgtgcaaccttgttggcactaaatttgttttatgatatgaacttctttagcatttgaatttgcctaaattttttagttctgagacctttttattgtacatgcttaacttgaataattttgactctattaagctcgtttagtctagcatattggtacctaaatgtttatatttgccgcctggcataagtttgcgtccctgctttgttttgaattcctgtaatgactgacttgtatctataatgtgttctaatctctgttaggacattcatcatagctatgaccttccccccatgctattttgtcacttattatgtctttattttgcttaatcttatatcccctagtgattatttggaacctttagagtagctatcctaacttgtgttttcttataaggtttgatactggtttgtcttactgatataagttggcatgtctgcttttctggtgttgtgatggatacttaacataacttggatccctaggctttaaatcctttaatttagtgctctactttggatttgtttggcattgtgcacccttatatgttgatcctataatctcagaaaaactgattcctttaactctcttaatgtgtttttctgcccaatatgctatctcttgctaagtgattgaatatgtaatatcaacctgccctctaagtcttgttgattctcttaactctcatgttctctatgtaatcaaccttgctacgtctgcttctaaagtgcaagtgcacctcttaaaattctatcacttaatcactgttctctcactctcatttgttatctatattattctgaatctattattcttggccggctgaaagccaaggccaccaaaactctttctatcgacctccctagttgagccctactcggggtccatttgagactcctgtgaactctaacactctaggatttggggtcctttgaccatttctttactggtggaacttaagctgtctctgacacttagcttttctccctaatcttttttgttgatctgcaaactgggttgcttaagtgatttttgtgtgattctataatttatttgggttatgtgtagttgtttggcttggcatcagttcctctgtgactttgggctgtgctgatgggcatagtctcctgtttgagaaatgcttggatctgggcatgctatttgcgacgaatgagcttgtgaaggcaggtaatactaggtatctccttttgggcctgctgttaggcctactattgttccatgtgtaatatttatacttatattcattatctgggcctgtaataatttgtgatagacaatggggacgttagtgaaattggaaaatgggtatattctaatgtttgcataaaagggtagaaaacatgcctatagaatttatatgacttgttattttatccaacctgccatatatgctatttagtgtccatgtacactagtagaaaccatgcttataggaaatcacacactcactcaacctattttactatgcctactactttacattattagacaacatgcctataggaaattagtgtcaataactattcgttaaatttgtgtaattacagcatgttcactagataccatgcttggcggatcacactaatgctcatctagatatcatgtctataggggttaattgactaattagcctattgttttcatcatattgctcacttggaaaacatgcctatagggatgaagcgttatagaactagtttcaactgccagatattagaaatcatccctatagtatgttgttattcgcctagaaactatgctaataaaatcaaacacgagtaatatttcaagctttcgaactgttttattgcctcatttagagattatgcctatatgatttgtaacacctataatctgtaaactcattgttccaacaaaatcagcactacatgtgcacttaaaatcaaaatcaaatagaaatcatgtctatagggtttaatgactctaatttgcctcaattctgaaactgtctgatgcctaatgtgaaaatttgcccgcatgcatttgttgcttatatgtggaggctaatctgggcctttaactgcctttatatgaagtcctatttgttttgaatgtcccctaactttatcgttttgagtaacctaagtaaagtctagaaccacccaaatagaggtcaaaatcctcctggaccatatgcatgagactggtagcgcaggcataggatacgacttagaattgaattaaagagcctttaggtaaacaactttaacatagtaatcggatagcaggagatgatagtctgtgcccgttgaataatatgaataactccccatcttaatggagctgcgaaatattatttatgttgcacgggatgatcctttaggctaaaaaacttagggccctcctttttctttatactctttgtcatctaatataggccgttatagttatatccttgtagtccatttgtaccaattctcattatgttataataaaactctttgaccttttattttcttcgtttatatgatcatcttgcctaattataatctatatagtcttaggttcggccgggacccacagttgtagaccttgaagagtacccaatactttatctttgaggtaatttgagtccttacccgatctttggtagcgttgactagtcaaacagagttatccgcataataggtgacctaacgcatcttaaaaactattaggtggcaactcttcttcttttaatactctatctcccactcaaaagagttgtcatatgtcgaaactcgctttcgtgagaaaacagagcgcgacacgcgtaatatctacattagtagagatctgctatagtcaagggcagatctaccttagccaagtggtgtcacgtgacaccgcttcgtcgaaaatctttacttattatttatatataaaataaaaaaataaaaaagtaaaatatgataaagtgacactgcttgtcacaaagagatgtgtagcttatcttgtaagactctaaagtgttctacgtgggttcgaacatccatagctttatttgatgttctaatacttttgtgcctcatctaaaaaatgtacataaccaaaaggggttttgagacactaagcaattagacattatcaaagcactaaaccagtggattatagtcataattgaagaaactagcacaattaattttttaaatggagggatgttgctattttcttagtaagttgtgctatttatttttttaggttattttttaaaatacgatgttattacagtaatttggttacatttaatatggtagtagtgcttacaaaaactcatgtgtacgctactggctacgctaaacgtaacccgaaacccaaataggaagagcaaaaaaagaagaccaagtaaatgagaaatcaatcaaaatatcaataaatacagagaaaaaattaccagaaggtttagagtgcctatgtggaaatttgcgtgggattctgtgatgatccggccgatcgtcttaagaatttatgccccgatctcctatttactattttccccatatttatttctgctattttgatttgccgggatgttcggttttgagtttgagagttttgggacacttagtccctaaatgagagcttaagttttgaaaaatttgaacgtagtcagaacaatgtgaagacggccttggaatggaattccgatggttccgttggccccgttgggtgatttcgggcttaggggcatatttggattgtgtattggaggtctgtagctaatttagtcttggaatgacaaaagtcgaatttcaaagttttcggtttgatagtgagattttgatatgaggatcagaatggaattccggaagttggagcaactccgcagtgttgaatgtgacgtatgtgcaaaatttcaggtcattcggacgaggtttgatagactttttgatcggaagcgtaaatttagagttttggagttcttaggcttgaatccgtggttgattcgtcgttttgatattgttttaggtgttctaaagattggtataagtttggctagtggtatatgacttgttcgtgcttttggttgaggttactggggcctcgggatgatttcagatgtttgacggaaaggtttggagttgaaagttgcagctgaagctttaagtctgctgtcataaccgtacctgcgacctggggaccgcaggtgcgaggtcgcagaagcggtcgagcaaccacataagcggtttaaggtaaaaatggagttgaccgtgttgatacccaatttttccctatataattttcatatgcaaaatactttcaaaatagcatatgtatgcatatataagcatgtccaagtgtttcattatttttcaatttttaaaacatttttaaatcaatttatcgccttattttatcagaaaaaaccaataattatttcccaaattatcatttttggtaactcctttattgtattctcatatttataccaaaatatagctaatgtaatttttgcacattttcttacaaatttattgagtattttaaaattaaattgcacataattgcaattttagcctattttaagatttaattgcgtttataattacaaaattaatcccaatatttttaatttaatatttgcgtattattaattaatttagtaccttcaatttgtttccaaattttgctattttttataaaaataaagagggaaaaagtggctatttaatactagccatacctatttaaattttagcccaaatcgaccccccaattaaccccaatttcaatttcaaatggaccggcccaattcctaaactacccgcccctgatccaattaagttcaactcgcccggccccccattaaatccaggtcgttgatgtaaatgatcaacgaccacaatccctcctttccctttttaatccaacaacaccccttaaccttaaatcatttcacctaaccagccgcctctgaaaccctctcctctctcaaaacactctcgaaccttctctaaccctagccgcctcccatcacttctaccttgaaacctaccgtgatccatggcttctcaggctatagaagtcttatacccacctcctgttgctcttacacacctgatctctgaagattcaaggcctgtccttgaaggtttgcacccagacctctgccgattcaaggtccagagtcatcgtcgaccttggtccggcgtatcatggtgttttcagcctggttctgacctctccgactcagatcagtgaccttttcaaagcctttctcatttctagggttcttttgaaaccctaaccctttgaggttttctctgatctctttagatccgttgtgtatctgtgctctctttgagttttcaaacgatctccctaacttttctttcgaaaattacttttcaaagtctttcttttacgatttaggattttctgaaaagcttaagtgtttctctgactttcttttccttttcttttgtgtgtatttgcctctactgtgttctatgttttccttctaccatgtatgttcttctactgtgctttctatgttccatttttgtatgttcttctactatgctttctatactatgctgttgtatgcttttctactatgtcctgctattttcttctactatgttttggtatgtttcgcctactgtattcttctaccgtgttcttaagtgttcttactattttcttttattgaactttgtttaagtttcttttaaaaggatcctcttaagcatgctttcttctgctgttcttatcagtcttttctcatcatgtttcgaattagtctttttactctgtttgccttgaacccctctactctatttacatgctattcatgagttctgttgctggaaaaagcatgctagaagtgtcaattcttttctgaaacctctaagcatgtttcgattcaactacttgtcttatcatctctgtacttgattcaaggcggaaaccctaaaatttgggggttctgccaggtttgatcatatatttgattgaactagggttttattttagaacccctaactcttcgagtctttgaattgagtttagacttctttgtttttatatgattctgacctttttactaaaactcttctacactggtttttcttattaatttacagtgacatgaaagttttctttcatacttaacatgctcacatgctttttatatatgatgaatttccctctaaatggttttcaaatttgcaattagttcaaacttccttatgaatgtggcttgattgatttctttccattgtttgctgattctccctgttactcgacctaagttaaaacccttcttcatcttttctgactcggttcattcatgcaaagtctcagactcttttgatttattgtttgttaattgatttgcttaccttatttgcacaaaccatgtatttcaaaaccttgtccttaaataactttttatgtatttgcccctgattgcatgttgtgcacaaattgcttactcaatttctttccttaaatggttttcacccgtttgaatctgaatcccttagttaagggaagccttatgtaattgattgacaatcagttccttaactgtttttcttaccttatttctgcttgatttttacactataaaaggcacaaccctcttcacacattacatcatcagaatccttctgagctcacactctctcataataatattctatttttgactgtactgtggcctgttttacaagacctactgctttcctttacttgttttcctgaaaactggtatgtcctaatttaattcttagcaccacaacaatgtgtagttactgcttttgtatccatgttcatattctacttttgtatatctcaacacttaaattagcatgttaatttccttatgtgtgttttgttatgaacccccattcctctatcacccctatgtgttttgagtggtgacttaaggcatggcaatgtaagttgttgtccatgaattaagtttgaaccactggggtcttgacctctaagcaaacaggccagaaggtgtgccagcatctcccattgctgggtatgctcttcagcccgcttttctgttgcctcttgcaacttcccattcccctatacccttatgtgtaatgatgtgagctgcttcccttttcctttttcccctttcagaattctacttctgcacttgcactctctcttagtccttaagttctgcccccctcttgtgagccttgccttgggaccttgagctccctctgaacttggacacctgagggctggcccttttatactgcactatggcttaatccgtgatacatttgggtgtaagcactgcccggagttcatatgatactcttagggaactctgacactccccaaataggagaaaggctttgaaatatgatcttttggagttgatttacttcatacttcagacaggaagtctgaatcaggctccccttggttgtactttttaatttctgatgtatttttcctttactttactttttctgggttgtaattattttgtaataaaactctcggggatggttagtgaaaaagtgagggtaactatgtatgcaaaaaggggtagataacctgcctataggagtttatgaatttctgcattcttatatagataccatgtctataggaatcttgcattcgcgtctacataccatgtctataagaatttctgcatagataccatgtttataggaatctcgcattctcatataggtaccatgtctataagaatttctacattctcatatagataccatgtctataggaatcttgcattgtcatgtaggtatcatgcctatagtttatttctgaacttctgcatagcgtatatatatcctgcctataggaatttttgaatttctgcacatcatgtacatatcctgcctataggttctttctgaatcttgcatatgcattcctcatcaggcaaacatgttcgtaggtcttaaataaccaactgcaattagatatcatgttcatagactttaaatgaaattcaacatctagatgtcatgcctataaggtttctgcattttttactacgtttataaaagtgtcctaaatcgacaacacatataaagcttgcctataggagccttaatcgaatttgaatcgtttcattcgcttataggtctaaaactagtaacaatgacgcatgctattttgctaaaacccgcctttctttaataacatatgattttcttaaattagtatgtattcatgtttgtttcatcgtttctggaatcagtagatatcatgcctatatgggtctttgtctaacacttaggcaagccatagggtgaaagtttataaactgaatcagatttttatcagctacaaccagcaggcaggcctgattcgggcttcttatctgaactatgtaataaatcaatctgcctccaccatttaagttttaaccagaccctaaaaagtacatgcaagtcatgctatattatgtgctttcttcgattttaaggaggtctgtttgagcccttttatttgtttatatgcttccccatacttgccatacgtgttttgattgtcgccttagaataggtacctccttcctttaggattagtagtcccaagtgcctccagagctgataagatgggggcgggtaatagcatgcaataagtaaacgagactattctgcgctttaataccttaacggggtaggaaagggtagacatgaatatgatgaccatgcgataacatcacgtgtagcccctcactgaggagtgattaccggatattgtgtggggtgatccatattattaataaacctaggacccccttccctttgttttctttgtttcttttaaatccttttaaaccatttcttttaagaaaatcaactctttttagttcctttttcttacttttgtttattgtaaccattacgtgaaaatcccctcttatttgaagcctttatttgcctatatgttatttgcacttaagtcacaatagtagtttggccgggaaccacactagtggatcctgaggggtgcctaacaccttcccattgggataatttcaagcccttacccaatctctggttactcaaaacaataccctcctaatgtcctaatgcactttaatcattatgtgacgactcttcaattcaaaacccaattcccgaacgggaacgagttgtctcgcaaatgtcacaaacccgatttttgtgagaaaaagggggcgcgacagcgtggcgactctgctgaggatatcttttaggcttctaccatttcaagctattactgtgactttacatttcttatgtgccttatttgtttaatacctttaagcatttaattccctcttctactgaaaaaaactaacttgtctcttgtttctttcccttgtttctttcacttctttcctttactgcactcctttattactattttaaattattgtaattattactttatgaatgtgcaaatatgtgacgacttgttttaattgcatatgcatgtttccaacatcatattccactcgtgccaaataaataccatagcaacgcttataatgagtggttgcgctcttccgatattatcaccctttaaatccggcaaaagcgtatttacggtaaaaccagtcgatcaacggtgtagtcaacggttccgtgcctttccctcttcagttgtccgctcaagggtaccagtctaaaaccccgtagaaaccttactctgtttaaactgtgcatacatcatggtcaaacctagctgagtcagttatgttgtcggcataatgactctttaagatagccttgtccaaagtccactgggtttcccaaaaacccaaacagacactatcatgttttgtgcatttttttggagaactaaatacttttatgtcaattattggtatttaatagtcgagtttggtgggggtaaggacctagcccttttgtcttgcagaaacatgaggcacgaagtccccagattcggcatggtcacaaacatccacccaaggttgctaagctggtgggaggatcttcattccagtgatcagactcttgtccggaaatacctaggaaatctaccttccctcctggaggtccaacccaacaataaaatcatagaagctgcaactctattctgggattgtgataagtctgtgtttcacttcggagagattgagatgacacccttgctagaggaaataggaggattggttagtgtaccatgggagacccccagttttttaatgtcggaaaatcgcaagggtagaggttttctcaaaatgatgggcctaaagaagaatccagacttgacatgtttgaaggagtcctacattctctttgattatttgtacgagaggtatggacacagcaaatcctaccgtacatatccggatgagttcgcccttacatcattggggcatattcaccgaaggttctttgtcttcatgttctgcttcttggggatgatagtgtttccaatgaagaaagcaaggatccacaccaggctagccatggtcaccaaaactttgttggagggaattggtggaaaaccatttagcatagtgcccatgatcatcgcagagatataccgagccttggaaaagtgtcaataaggagccccacacttcgagggctgcaacttgctactccatctctagctcatggagcatcttcaaaggggtaaatatcgacaagagattcagcatagagactgggacgatcatatagccttccatcaacaaaggcgaatgaactacatgcccaacatgtttgctaagccagaagatgccaaggggtgggtggagatgtttgaaaatctaactgaggatcaaatacaatggatgttcgagtggttccctactgaagagttcatcgcccgatccaaggatgcaccatttctgatactgatcagtttgataggaacctaccattatgtccctcttcgagttatgagacaggctggtaggaagtaggttataccaagggtcaataagatgagtcacatccgggctgacttccaagctgatgacagtccttataagtgccaagctcagcatatgtggcattgcaagatcatcacgggaagagatactatcgaaccagacagataccatgctggctgcaccccatactattcaggctggctggaggataatcacaatggtctgggccaacccgggtctgttcgaggtcacagaatcatcgatgaaagggctgaagcacaggtcaaatacaaccaactgcgtaagaggattctggaatgtgaaagcgagcaccgtgagattcaagaagcccaccaaaaactgattgaagagtggaaagacatggctgtcagtgccaacaagcgattaggatacctagaacaaggtttagtggagcatggaaaagaagtttctcaagaggatcgaggactgccagaatgctgaaggaaacgagggtggacacctggctagagcctacctgctgctgggacttcgtgagctggtgaagctgttcgatggatccaaagatgccgagtctggggaaggtccttctgggaccaaataaataggagttttcttttactttatgaaatgtaataaggccaatggccactagtgacattttatttcttgttatttagtgtcgttttagtattcgtctactttttatcaataaaattaggcatttagtatttaaagttcttaaaatcaatttgtcgctaggcctacctcgggcaaaacaaggcttccaaattaggacgcgatttacattcttgcactatgtgtttaaatatcgcaacactttcttataatccccactgacttgttacctttttgtttttactttttgtttatttactcccctccctaaaggttagttcgtgtactctggcatcgttatcatattccacaagatcaaagggccctccacccactcctcctcctagtcctatcagaagcaggaacaaaggaaagatggaagatttgaacaacaccagaaaggaaaacttaactgaacgggtagaggtcactcatggtgctcaggtctccaaagaaagtgcgtcccaactcgagcagaaactgttgaaatttcaggaggaacttgatcaggttcagaatctggcaaacttatcatttttcctcaccactccagaatcaattttccgaacgctcagaaccccacgcctccacaaaacatcccaaaaccacaaaatcatcccgctcctcaccaccactgtaatacttgccacactccactactcatcccagaacctctaaattccacaaatgaccatttccatgcccaccataacgctcccatctatgtggaaaccatgcaaccctccacccaacctgtctcaagcacacccgagtctgatgataaagactaactcatcaggaacctggttgcggaactcaagaaattgactagtcgaattcacggtgtcgaaggaagtaaggggattgaagggttgaactacgaagatctttgcatacaaccggatgtcgaactgcccgaggagtacaaacctcctaagttctagattccgagagtccacttgagaacatactatgacaagctggtcggagtagggaaagacgaaaggattcacatgaagcttttcatgaggagtctgaagggagatgctctatcttggtacattagccaagaccctaagaaatggtcgaactgggtgagtatggcgtccgactttatggacaggtttaggttcaacacagaaaatgcaccagatgtgttcttcatccaaaacttaaagaagaagcccacagaaacattccgcgagtatgccattcgctgtagatcagaagctgctaaggtcagacctgctttagaagaagaacaaatgaacaagtttttcgtccgggctcaagacccacagtactatgaaaggatgatgttgattaagagccagaagttttccgacatcatcaagctaggagaaaggatcgaggaaggcatcaaaagtggtatggttacaaactttgaagctttgcaagctaccaataaggctttacagtctggtggtatgtccaagaaaagggacgtaggtgccgtaatggttgcacaaaaagccaaatcccctatcaaataccaagcctatccgatacctccactcacatatcagcctacctcgaattaccaagaaccctcaccctcttaacaagctccatcacctacttaccaatcacccccacctcctacatatcaacctactttacccagatattcccaacccgcacatgtctaccaagcctacaatgctcagccatcccactatcaatcacctcccacatgtcaaaactttcctaaacctagaccaaatttcgaccgcagatcccccaaacagtataccgccattgctgaaccgattgactagctgtacgaaaggctcaaagatgctggttatgtcacccctatccctgctataacccctgaaaacccttctcagtgggtcaatccaaataaatcctgtgcataccattccgacatgaaagaacataccattgatgaatgccgttctctgaaagataagatccagactttgatcgataacaagatcattgtagcaaaggagcctactccgaatgtccgcaacaaccctttgccggaccataagggtggaggtgttcacatgatttaaatagaagatgattgggatcccaaaggatcgattggtttaatcacagaaggtgacgaactaaagaagccgatagtcaccctcaatccaatcgtagtcccgacgcagccttctggggatgacgaggtaaacatatctgtaccacttgaatttgaagcaccaccccctacaaagaagccaacaccaattgcagtcgagtttgggtctccaacaaacgcacccgcaccgtttgaagttgaggttttaccctccaaaatacatgctccgttcggagtaagggtgcccatcccagtagcaatgtcggccgtaacaccatttcatacaaatgccataccttgggattacacagccgaggcgagaaggaaaaggaaagctaaattcagggaaatagttgcggcccagggcatgacaagaaccgacagggtttatactctggagcatttagctgagtcgagtaagcaggcctctggtcagatgtccatcactgaaactgggcccgatgatctccggaaaaagatacaagccaaggaatactcagtcattgattagctaaacaaaacactgacacagatttctatcctagctttgctgcaaagttccgatgcacataagaatgccttgttgaaggtgctgactgaggcatatgtaccaagaaacatcactggagaagaaatggaaaatatggtagggcaggtattggaaagtcataagatcacttttcatgaagatgagctgccactagaagggttgagtcacaacaaggcattgcacatcaccgtacaatgcgaagattattttatcactagggtcttgattgatggagggtccaacctcaatatttgtcctttggtaacactcagaacattggggaaggggctgcatgagatcaaggacggggccatcaacgtcaaagcttttgacagttcccaaagatccaccattggggaaatcagcctatgtttgcaaatggggcatacttggttcgatgttgatttttaggttatagacatgccgacatcttacaacttgctattgggatggccgtggattcatgccgttggggccgtagaattgacactgcatcaggcgatgaaatttgagtggaaccaccaagaggtaatcattcacgacgatggtagaaatcccatatatagtcgccaaaccatcccagcgattggaggaaggaaaaggataggcgggtaaacctatcaccatttcgagcgagtcaatgccgctgacaaagacaagtggtggggaaacaaaattgagagcatactaaattggtgcggatatgaacctggcaagggacttggcaagaacctccaaggaatcgccaagcctatcaaattgaagaaacatggcaccaagtttggtctgggatatgagtatacttgggaggaattcaacaactggtcgccaccatggcacggtccatactacccgctggagcagccaataccacatttggagcagactttccagccggccgatgttatctatgggtcggaagaagagaaagcacttgtagcagtaaggaatttgttcttaaaaggtaatgacatggattgttgtgtcattttcgaggaggagggggaggaaggcccttccatacaggccgtaagtcgaggagcatacctcaacaattggaccatcagaaccaccagagcccggaaagcctcggggtagcaaggctgaacaaagcatcatgcactatcttttatttttactaattgattttcctttcgtatttttgaatttttgcaataagatcttccaatgttcaaaacagttatgaaatttatcaaagcattttggtttccttacaaatcttactcttattattttctctcattactttacttgtacaacattactattacctatcttgatgaaccaatggttgtgatatgcaacaagacaacacaacaaacgtatacagatttagaggaagatcacatactgaaagagattgttaaagaagtcaaaaattttgagaacagacctaagtccaacctagacaagacagagattgttaacctgggagatgcagaaattatcaaagaaactcggatcaacgttcatttgtcaccgtcagaaaaggaagaatacactgaatttttgaaggaatatgaggacatattcgcctagtcatatgatgacatgactggtttgagaacatctattgtgggccataaactgccaactgatccgacatgtccaccggtaaaatagaagctcagaaagcttaaacccgacatgagtctgaaaatcaaggaagaagtcattaagcaggtcaaagctaaggtcctcagggtagtagaatatccgacatggttagccaatattgtgccggtgccaaagaagaatggtaaggttagagtctgtgtcgactaccgggatatcaatcgggccagtccaaaggacgacttccctttaccgaacatacacatcctgatcgacaattgcgccaagcatgagttgcaatcatttgtagattgcttcactagatatcatcagatctggatggacgaagaagatgctgagaaaacggctttcattacaccgtatgggatgtactgctacaagatgatgccattcgggttaaagaatgcagggccacctacatgagggccatgactactatcttccatgatatgatacacaaggagattgaggtgtatgtagatgatgtcatcataaagtcctagaaagccactgaccacatggaagatttgaggaagttcttcaacatactaagaagatacaacctggaactgaatcccgtgaaatgtgcatttggggttcctgccagaaaattacttcagttcattgtgagtcgccaagggatagaactggatccatctaaggtcaaagctattcaagaactgccaccgctgccagatacatgcagacatgataaaggtgcctccaaatgagcttaatgcaacaagcttgccgtggcaattcgccgcttggggaatggatattattggaccaaccggaccctccgcatcaaacgtgacaggtttatcctagcagcaattgattatttcaccaaatgggttgaagcagcatcttacagggcagtgactaagaaagtcatggcggatttcgtccgcgaccatatcatgtgtcagttcggaattccagagtcaatcattactgataatggctccaacctcaacagtgatttgatgaaatccatgtgtgaaaccttcaagatcaaacataagaattctacagcttacagacctcaaatgaacagagccgtagaggctgccaacaagaatatcaagaagatactaaggaaaatgatagagaagcataagcagtggtacaaaaagctctcatttgctttattgggataccgcaccacaatcctcacatcgacaagagcaaccccctatatgctggtttacggtacagaggcattcattcccgccgaggtggaaattccctcattaagaatcatacaggaagcaaagctagacgatgcagaatgggtgaagaatcgttacgaggagctagctcttatagatggaaagagaatgaatgcagtttgccatggtcaactttatcagaacaggatgtccagagccttcaacaaaagagtcaagccgacacagttcacaccggggcagctgatgttaaagaaaatctttccacatcaagatgaagccaaggtgaaattctcttccaactggcagggtccgtacatggtttaccaggttctaacaagaggagccctcatactcgcagaaatggatagagaagtctagccaaagccgatcaattcagacgcagtcaagcgatactatgtgtaacctttatactttcttttatgatgtaatttgaactacgcatgactcgattaccgtttaataggggatacgtaggtagccctatgggtttggtcacaattcaataaaatttccattttccccgctattggaaactggggcagaattttgaggaggaccctcaaaattccgaagtcgattccagccatttatcattaacagccgtcaggagcagcaacccagtaaactggggcagaattttgaggaggaccctcaaaattccggagcaagcgaagttgcaatgtctttaaccatgtcgcagtcgtcggttcatctaaagaaaattattcttaattatgcacttatgttatgcttttactaaatcatgcatgtttattactaaaattgccttgtttagaaatgctaccccaatgatacgtacaatatcaccagatcaaagccgagcaggtcaagcaaagccagcggggatacgaactaactttcccccctttacaaactcacgattttcctttgaatgcaggcacttgagttgcaaaatcatcaaatatgctatacgctcactcacaaagtttaggaatacaactctccgaactgttgcacttgctcgcaactgctatccgcacaacagtgtccccaacatgcataatatccccagcaatcacgataccagaatccgctatcagctaagaaaactctattgccatttgccatttttacttcctgcataaggctaccattttgccttccacggttaagctctacctccatctacattctctgcattatataaggctaccattctgccttccgagactaagctctgtctccatctatattctgtgtattgcataaagctaacattttgccttctgaggttaagctctacctccatctgcattctctacattacataaggctaccattccgccttccaaggttaagctctacctccatctgcattctctacattgcataaggctaccattctgccttccgaggttaagctctacctccatctgcattctctgcattgcataaggctaccattctgccttccaagactaagctctgtctccatctgcattctctgcattgcataaggctaccattctgccttccgagactaagctctatctctatctacattctctgcattgcataaggctaccattctgccttctgaggttaagctctacctccatctgcattctctgcattacataaagctaccattctgccttccaaggttaagctctacctccatctgcattctctgcattgcataaggctaccattctaccttccgagactaagctctgtctccatctgcattctctgcattgcataaggctaccattctaccttccgaggttaagctctacctccatattgcatggctgaaagatcgccacttcatttacatcttgcatggctgaaagatcgccacttcatttacatcttgcatcggctgaaagatcgccacttcatttacatcttgcatggatgaaagttcgccacttcatttacaccttgcatcggctaaaaagatcgccactttatttacatcttgcatcggctgaaagatcgccacttcatttacatcttgcatcggctgaaagatcgccagttcatttacatcttgcatcggctgaaagatcgccactgcatttataccttgcatcggctaaaagatcgccactttatttacatcttgcatggctgaaagatcgccaccttatttacatttgcattggttgaaagatcgccaccttatttacattcgcactggctgaaagatcgccaccttatttacatttgcactagccgaaagatcgccacctactgcatcatgggctgaaaatttgctaatttgtccaaaggcgtcattgttcggaggcaccattttcatagcacgagaacgctatgccatggcctgaggaccccttttatcttttgcatgtcattagtcaaaggcatcatagttcggaggcatcattctcaaagcccgagagcaccatttcatggcctgcgaatccttattatacgcttcatggcccaggacgtcatggtctgaggacgtcatcctaactgtccaaagacaacatttcatggtccgacgggaacttgcatcatgtttaaatttccgcacaacatatggttcatttgcaggtaaaccggcgagcaacgaccatctcagtagaagaaatccttctccagttcccgtagctctattaaactttaaccatccagcccaacctaaacattgcgtccgttcttggaaaacctctatcggcatactctgccgacggatcctgaactatatatggcctgattcctataagaccagggatatgtaggaaactcaggaaccatggcacgatcaacattttcaaaccatttcgttcgatcaaaattggccatcatatctttacccgacaactctttcatccttcccgggtaaagaaggacagctgttgatacccaatttttccctatatatttttcatatgcaaaatactttcaaaatagtatatgtatgcatatataagcatgtccaagtgtttcattatttttccaatttttaaaagatttttaaatcaatttatcgccttattttatcagaaaaaaccaataattatttcccaaattatcatttttggtaactcctttattgtattctcatatttataccaaaatatagctaaggtaaattttgcacatttttacaaatttattgagtattttaaaattaaattgcacataattgcaattttagcatattttaagatttaattgcttttataattataaaattgatcccagtatttttagtttaatatttgtgtattattaattaatttagtaccttcaatttgtttccaaaaatcattttgctattttttataaaaataaagagggaaaaaatggctatttaatactagcccaacctatttaaattttagcccaaatcaacccctcaattaaccccaatttcaatttcaaatggaccggcccaattcctaacctactcgcccctgatccaattaagttcaacccgcccggccccccattaaatccaggtcgttgatgtaaatgatcaacgaccacaatccctccttttcttttttaatccaccaacaccccttaaccttaaatcatttcacctaaccagccgcctctgaaaccctcccctctcttaaaacactctcgaaccttctctaaccctagccgcctcccatcacttctaccttgaaacctaccgggatccatggcttctcaggctatggaagtcttatacccacctcctgttgctcttacacacatgatctctgaagattcatcgccggccttgctccggcgtatcatggtgttttaagcctggttctgacctctccgactcagatcagtgaccttttcaaagcctttctcatttctagggttcttctaaaaccctaacccttcgaggttttctccgatctctttagatccgttgtgtatctgtcctctctttgagttttcaaacgatctccctaacttttctttcggaaattacttttcaaagtctttcttttacgatttaggattttctgaaaatgcttaagtgtttctctgactttcttttccttttcttttgtgtgtatttgcctctagtgtgttctatgttttccttctaccatgtatgttcttctactgtgctttctatgttccgtttttgtatgttcttctactgtgctttctatactatgctcttgtatgcttttctactatgtcctgctattttcttctactatgttctggtatgtttcacctactgtattcttctactgtgttcttactcttttcttctattgaactttgtttaagtttcttttaaaaggattttcttaagcatgctttcttctgctgttcttatcagtcttttctcatcatgtttcgaattagtttctttactctatttgccttgaatccctctactgtatttacatgctattcatgagttctgttgctggaagaagcatgttagaagtttcagttcttttctgaaacctttaaacatgtttcgattagactacttgtcttctcatctctgtacttgattcaaggcggaaaccctaaaatttgggggttctgccaggtttgatcatatatttgattgaactagggttttattttagaacccctactcttcgagtctttgaattgagtttggacttctttgttttcatatgattctgacctttttactaaaattcttctacaccggtttttcctattgattttatagtgacatgaaagttttctttcatacttaacatgctcacatgctctttatatatgatgaatttccctttaaatgattttcaaattagcaattagttcaaacttccttctgaatatggcttgattgatttctttctattgtttgctgattctccctgttactcggcttcatcttttctggctcggttcattcatgcaaaattttagactcttttgatttactgtttgttaattgatttacttaccttatttgcacaaaccatgtatttcaaaaccttgtccttaaataactttttatgtatttgcccctgattgcatgctatgcacaaagtgcttactcaatttctttccttaaatggttttcacccgttttaatctgaatcccttaattaagggaagacttatgtaattgattgacaatcagttccttaactatttttcttaccttatttctgcctgatttttacactataaaaggcacaaccctcttcacacactacaacatcagaatccttctgaactcacactctctcataataatattctcttcttgactgcaccgtggcatgttttacaagacctactgctttcctttacttgtttccctgaaaattggtatgtcctgatttaattcttagcaccacaacaatgtgtagttactgcttttgtatccatgttcatctgctatttttgtatatctcagcacttaaattagcatgctgatttccttatgtatgttttgttatgaacccccattcctctatcacccctatgtgttttgagttgtgacttaaggcatggcaatgtaagtagttgtccatgaattaagtttgaaccactggggtcttgacctctaagaaaacatgccagagggtgtgccagcatttcccattgccgggtatgcccttcagcccacttttctgttgcctcttgcaacttcccattcccctatacccttatgtgtaatgatgtgagctacttcccttttcccttttcccctttcagaatcctacttttgcacttgcactctctcttagtccctaagttctgcccctctcttgtgagccttgccttgggacctcgagctccctctgaacttggacacctgagggctggcccttccacattgcactatggcttaatacatgatacatttgggtgtaagcactgcccgaagttcatatgagactcttagggaactctgacacatcccaaatagaagaaaggctttgaaatatgatctcttggagttgatttacttcatacttcagacaagaagtctgaatcaggctctccttggttgtactttttaatttctgatgtatatttcctttactttactttttctgggttgtaataattttgtaataaaactcttggggatggttagtgaaaaagtgagggtaactatgtatgcaaaaaggggtagatgacctgcctataggagtttatgaatttctgcattctcatatagataccatgtctatatgaatcttgcattcgcgtctagataccatgtctataagaatttctgcatagataccatgtttataggaatctcgcattctcatataggtaccatgtctataagaatttctacattctcatatagataccatgtctataggaatcttgaattctcatgtaggtaccatgcctatagtttatttctgaacttctgtatagtgtatagatatcctgcctatatgaatttttgaatttctgcacatcatgtacatatcctgcctataggttctttctgaatcttgcatatgcattcctcatcaggcaaacatgttcgtaggtcttaaataaccaactgcaataaaatatcatgttcataggctttaaacgaaatttagcatctagatgtcatgcctataaggtttctgcatttttactacatttataagagtgtccaaaatcgacaacacatagaaagcatgcctataggagccttaatcgaatctgaatcgtttcactcgcttataggtctaaagccagtaacaatgacgcatgctcttttgctaaaacctgcctttctttaataacaaaggattttcttaaattagtatgtattcatgtttgtttcatcatttttggaatcagtagatatcatgcctataggggtctttgtctaacacttaggcaagccatagggtgaagtttataaactgaatcagattttttatcagctacaaccggcaggcagacctgattcaggattcttatctgaactatgtaacaaatcaatttgcctccatcatttaagttttaatcagaccctaaacagtacatgcaagtcatgctaccttatgtgccttcttcggtttaaatgaggtctgtttgagctgttttatttgtttatatgcttccccatacttgccatacgtgttttgattgtcgccttagtattttacatttttaaccataaataagcccaatacctcctccctttaggattagtagtcccaagtgcctccggggatgaaaagatgggggctagtaatagcatgcaataagtaaacgagaccattccgcgctttaataccttaacagtgtgggaaagggtagacatggatatgatgaccacgcgataacatcacgtgtagcccctcattgaggagtgattatcggatgttgtgtggggtgattcatattattaataaacctaggacccccttccctttattttctttgtttcttttaaatctttttaagccatttcttttaagaaaatgaactctttttagttcctttttcttacttttgtttatttgtaaccattacgtgaaaatccactcttatttgaagcctttatttgcctatgtgttatttgcacttaagtcagaacaatagtttggcctggaaccacactagtagatcctgagggatgcctaacaccttccccttgggataatttcaagcccttacccaatctctggttactcaaaacaaacccctcctagtgtcctaatgcactttaatcattaggtgacgactcttcaattcaaaacccaattcctgaatgggaacgagttttcttccaaatgacacaaacccaattttcgcgagaaaaagggggcacgacaaaccacagatgcggtcagggcaccgcataagtggctccacatttgcggtaagttagtcgcaggtgcagaaagtcctcctttaatgaaaagtcgtagatgcgaccttggatccgcagaagagggaccagagatgcggtttcactggtcagaaaatagggatttcgagggtttagtttcaaaacttggaaaaatcaaactggagctcgggagagggcgattttgagaggaagttgaagcggaaatcattgggtaacaattctttaaccctttctagttatatttcatcaatctattgttagttttatcctttaatttcggattggagatgaaaattggggaaaagttggaagaaagttcttagacctagaatttgacttttgattgggaatttgaccttggattttggtacttttggtatgactgaactcgtgagagtgtgaggattctgaaaatgtaaattttaaccgatttcgagacatgggcccgaggggcattttggtcattttacctaatttcgcatgttagcttagaatatttttgtagaatcagttacttaaagtgttatttacattataaaattgaagtgaattgatttgggctatttggagtcgagtactcgtggcaagagcatggtttcagattgatttaagttggttcgaggtaagtggcttgcctaaccttgtgtggaggacattcccccttaggatttggtattgtggtaattgaattgccttgtacgtgaggtgacgaatgtgtacttgtgttaattgttgaaaaacctattttcactaaagtagctttaattgtgttttccttttcttgcttactctacttgaaattttagcctgctgttagcttagagaagcatgtttaattgacttaattgttttattacttaaaccgccttaattgtatcatgtgaagcatgttaggttggaattacctattttacttggtacgaaattgagcttaattgagtattccttgtgttgttgttgtgtgttttattttgggactatgggatggcatcccgagagatcccttgtacgtatttatggtttgagttgaggtgcaggatactgagagatctctagcacgtatattgaggatgctaagagattctcgagataccaggagatccctagcacatattgaggataataagagatcatcgggataccaagagatccctagcatatattgaggatatcaagagatccctggtacatattaagggtactaagagatcctcgggataccaagagatcccatgcatatattgaggataccaagagatccacgggataccaagagatcctagggataccaagagatcactgacacatattgagggtactaagagatcctcggaatactgaggatccccgattattatccttgggaagagtagtattccgtgtgattgtttttgcctctgtttcagttgtagttatctttattatcttatattaattcttattgttatctttcaactgtactgttttatcttattctatcacaccatatattttatttaatattagtagggccctgcccttccttgtcactacccaaccgtggttagacatggcatttactgagtaccactgtggtgtactcatgccctttctgtgcatgtttttcatgtgcagatccaggtacctccacccaaacttatcacgcttgagacgaagcgttcgtagaggctccaaggtatatctgccgcatccgcagactgaagagtccctttctactctcccttttaggtattagcccttctgtattttcttcccttgttagatattctggggttagatacttgtatacactcaaagacttgtgttcatgagattccgagttttgggaaatgtattagtttttgagagttgatattgtgcatgccaagcgacatttttaaacgatggtttatttcactattttggtttttaattgtttcttccgcaaattggtttatttttcacattgttaggcttacctagtcgtagagactaggtgacatcacaagttggttcatggagggcgaatcagggtcgtgacaagttggtatcagagctttaggttcataggagtcatgaatcacaagccaatttattagagtctcatggatcggtacggagatgtctgtacttatctgcgataggctatgtatctgttaggaaaattccacttcatttgatttctttgtcatgtgaggtttgatgtcacaattttaaacttttatattctattctctcacagatggtgatgacatgcgctatccgagatgatcaggcacccacgccccctactgtagccgtcagaggccggggccggggtagaggccgaggacacgcatgtggtgtagctagagcacctacgcgagctgccaccgaggtaccaccagcagttccagccggagtccaatcatttgatacacctactgctactactactccaacacttcaggagactctagcacaattcatgagcatgtacaccactttggcttaggcagggttgcttccccttactgtagctacatctcaggccgggggaggagcacatactcccaccgccacactcctgagcaacaagtgtatgttgagtaggttcccaaaattattcctgtaccgcctgcagtccgagattagcccgtggacagggcagcaatttccgaggatgagcagctgaggcttgagaggttcaagaagtacaagcctcttatatttaatggtctagcatcggatgatgctctgggatttctagatgagtgttaccgcattctccgtaccatgggtatattagggggtttccttcactaccttccagcttcaaggagccgcctatgagtggtggcacacctatgagttagacagtccggatgaggctgcttcactatcttggactcagttttcagatctattcttgagagagtatgttccttagagcctcagggacgcatgacgcacagagtttgagcatttgcaccagggtgctattattgtctcagagtatgctatccgttacactagtttggctagacatgcaccaaccttggtttctactgttcgcgagagggttcaccagtttattaaggggcttatcccagcattaggtctagcatgactcgtgagttggagatggatatttcttatcagcaggtggtgagcattgctaggaggattgagggtatgcatggtagggagagagaggagagggagaccaagaggtctcgagagtcgggctattattttggtgcccgtgccccagctacaggttgtcatggtaggagttatatgagtcaccctattcattcagctcttccagtagccagtggtattccagctcctcttaggcctcaggagccttattatgcacctccggtatctagcgcgcctcttgcacgggatgctttcagaggtcagtccagcagacctggcccgagctagtcacaacctccacgtcctcccagatcttgttttaagtgtggggacacatgccatgttgtgagggattgccctagacttgggaggagtgcgcctccacaaacttctcggccacaacgcgccccgctgagttctcaggctatggttacagctccagttgctaccccacctactcagccagctagaggtggaggtctgggaggtagaggtcaccctaaagggggaggccaagcccgatactatgccctttctgcccgtaccgaggctgttgccttctattctgtcatcataggtactatactagtttgtcacagagatgcatcggttctattcgatccaggctccacttactcttatatgtcttcttattttgctctgcatttgggtgtacctcgggattctttgttcccctgtttatgtttctactcttgtgggagattctcttgttgtgaaccgcatttatcggtcgtgtttggttgctcttagtagttttgagactagagccaatttattgttgctcagcatggtagattttgatattatcttgggcatggactggttgtcactccattatgctattcttgattgtcacgccaaaaccgtgctggctatgccaggtgtaccgcgtgttgagtggaaaggtactttagatcacactcccagtagagttatttctttccttaagtctcagtgaatggttgagaagaggtgtgatgcgtatttagcttatgtgagagatgttagtattgatacccctttagctgattcagtcccagtagtacgagattttcccgatgtgtttccaactgatcttccaagcatgccgcctgatagagataatgattttggcactgatgtgttgccgggcactcaccctatttctattcctccgtattgtatggctcctcctgagttgaaggagttgaaggagttgaaagatcagttagaagaattgcttgataagggttttattcggctgagtgtatcaccttggggtgctcctgtcttgtttgtgaagaaaaaggatggttctatgcatatgtgtattgattatcgctagttgaacaaaattaccgtaaagaaccgttatcctttgcctcatattgatgatctgtttgaccagcttcaaggcgcacatgtatttctaagattgacttgcgctcaggttgccatcagttgaagattcgggagccagatatcccgaatactgctttcaggactcggtatggtcattacgagttccttgttatgtcatttgggctgaccaatgccccagcatcctttatgcatttgatgcacagtgtgttccggccgtatcttcactcattcatcattgtctttattgatgatattatggtatattcccggagtcgggaagatcatgagcaacacttgaggactatgcttcagactctgagagagaagaaattatatgctaagtcctcgaaatgtgagttttggttggattctgtggcattcttgggtcacgtggtttctagtgagaggataaaagtggatccgaaaaaggtagaagtagtgcagagttgtccaagaccatcctcagctatagagatccgcagttttcttggcttggcgggttattaccattgttttgttgaggggtattcatcgattgcagcccctatggggtgctccgttcccatggacggaacagtgtgaagcgagctttcagaagctcaagatagctttgactacaaccccaatattgatattgcctacatgttcggggtcttacactgtctattttgatgcctcgaggattggccttggagcgattttgatgcaggatggtagggtgattgcctacgtgtccagacagttgaaggttcacgagaagaattatcccatccacgaccttgagttagctgccattgttcacgccttgaagatctgacgtcattacttgtacgatgtcccctgtgagatttatactgatcatcggagctggcaacacatgttcaagcaaaaggatctaaatttgcaccagaggagatggttagagttgctgaaggactatgatatcactattttttatcattcgggcaaggccaatatggtggccaatacttgaatcgctgagcaaagagtttgggaagtttggcttatttaccgacatcagataggcctatggcgatggatgttcaggccttagccaaccagtttgtgagattggatctttcggagcccaatcaggttctagcttgcgtggtttctcggtcttccttatttgatcgtatcagggagcgtcagtatgatgaccctcatttgcttgtcctcaaggacaaggttcagcatggtgatgccagagatgtgactattggtgatgacggggtattgaggatgcagggccgaatttgtgtacctaatgttgatgggctttgggagttgaatctagaggaggcccatagtttgcggtattccattcatcccggtgacgcgaagatgtatcaggatttgaggcagcactattggtggtggccgatgaagaaagatatagttggatttgtagctcggtgcctcaactgtcagcaggtgaagtatgagcactagagactgggtgggttgcttcagcagatagagattccggagtggaagtgggagcggatcaccatggactttgtagttgggctcccacgaactttgagaaagtttgatgctatttgggtgattgtgcatcggctgaccaagtccgcgcacttcattcctgtgtgtactacctattcttcggaatgtctagcagagattcatatccgggagattgttcatctgcatggtattccagtttccatcatttcagatagaggtactcagttcacatcacgattctggaaggccgttcagcatgagttaggtagtcgggtggagttgagtacaacatttcaccctaagatggacggaaaatccaagcgcactatttagattcttgaggatatgctccgtgtgtgtgtgattgagtttggagggtcttgggatcagttcttgccattggcggagttcgcctacaacaacaactatcaatccaacattcagatggcaccttatgaggctttgtatggtaggcggtgtagatccccaatgagttgtttgagcaaggtgaggccagattattgggcacagacttggttcaggatgctttggagaaggttaaggtgattcaggatagactccgtacatcccagtccagatagaagagttacgcagactaaaaggttcgtgatgtttcctatatgcttggagagcgggttctgcttcgggtatcacctatgaagggcgttatgagattcgggaagaaaggaaagttgagtccgaggtttattggcccttttgagatattgaggcgtgttggggaggtttcttaagagctttccctacctcccagcttggcaggagttcatccggtatttcatgtttcgatgctctgaaggtatcacggtgattcatcgcacgtgttggatttcggttcagtctagttggacaaggatctatcctatgttgaggagccagtggcaatattggacagacatgttagaaagctgaggtcaaagaatattgcatcagtaaaggttcagtggcggggtcagccggtcgaggaggcgacctgggagatcgagcaggatatgcgcagccgttaccctcatcatttcactacttcaagtatgtctctatgctcattcgaggacgaatgaatgtttaagtgtaggaggatgtaacgacccggccggccgtcttaagaatttatgccccgatcccctattaactacttttcccgtatttatttatgatattttgatttgccaggatgttcggttttgagacacttagtccctaaatgagagcttaagttttgaaaaatttgactgtagtcggaaaagtttgaagatggcctcggaatggaattctgatggttccattggctccgttaggtgatttcgggcttaggggcgtgttcggattgtgtattggaggtccgtagctaatttaggcttgaaatgctgaaagtcaaatttcgaagtttccggttcgttagtgagattttgatccgagggttggaatggaattccggaagttggagcagctccatagtgttgaatgtgatgtgtgtgcaaaatttctggtcattcggacgaggtttgatagactttttgatctaaagcataaatttagagttttagagttcttagacttgaatccgtggttgattcgttgtttcgatgttgttttaggtgttctaaggattggtataaatttagatagtggtaaatgacttgttcgtgcttttggttgatgtcccgggggcttcgggatgatttcagatgtttgccagataggtttggagttgaaagtagcagctgaagctttaagtctgctgtcataaccgcacctgtggcttggggaccgcaggtgcgaggccgcaaaagcggtcgagcaactgcagaagcggtttaaggtaaaaagggagttgaccgcagatgcggtcagggcaccacagaagcggctccgcatttgcggtaaggtagtcgcaggtgcggaaagtcctcctttaatgaaaagtcacagatgcaaccttggctccgcagaagcgggaccgctgatgcggtttcactggtcagaaaataggaatttcgagggtttagtttcaaaacttggaaaaatcaaattggagctcgggagagggcgattttgagaggaagttgaagaggaaatcattgggtaacaattctttaaccctttctagttatattccatcaatctattgttagttttatcctttaatttcagattggagttgaaaattggggaaaagttggaagaaagttcttagacctagaattcaacttttgattgggaatctgaccttggattttggtatttttagcatgactgaactcatgggagtgtgaggattctgaaaatgtaaattttacctgattccgaaacgtgggcccgaggggcgttttggtcattttacctaatttcgcgtgttagcttagaatttctttgtagaatcagttatttgaagtgttatttatattatgaaattgaattgaatagatttgggccatttggagtcgaatactcgtggcaagagcgtggtttcagattgcctaaccttatgtgggggacattccctattaggatttggtattgtggtaattgaattgccttgtacgtgagatgacgagtacatacttgtgctaattattgaaaaacccgttttcactaaagtaactttaattttattttccttttcctgcttactttacttgaaattttagtctgttgttagcttagagaagcatgtttaattgacttaattgttttattgcttaaactgccttaattgtattatgtgaagcatgttaggttagaattacctgttttacttggtacgacattgagcttaattgagtattccttgtgttgttgctgtgtgtttttactttgggacaacgggacggcatcccgggagatccctgtacgtatttatggtttgagctgaggtgcgggatacagagaaatccctagcacgtatattgaggataccaagagatcctcgggataccagaagatccctagcatatattgaggataacaagagatcctcgggataacaagagatccctagtatatattgaggataccaagagatccctggcacatattgagggtactaagagatcctcgggataccaagagatccctaacatatattgaggataccaagaaatccctggcacatattgagggtactaagagatccttgggatactgagagatccctggttattattcttgtgaagagtagtattccttgtgattgtttttgcctctgtttcagttgtagttatctttattatcctgtattaattcttatcgttatctttcaactgtattgttttatcttatactgtcacaccgtatattttatttaatttcactagggcccagaccttcctcgtcactacccgaccgaggctaggcttgacaattactgagtaccgttgtggtgtactcatgccctttctgtgtatgtttttcatgtgcagatccaggtacctccacccagacttatcacgcttgagacgaggcgttcgtagagattccgaggtatatctgccgcgtccacagaccgaagagtccctttctactctcccttttaagtattagcccttctgtattttcttcccttgttagatattctggagttagatacttgtatacactcaagggcttgtgttcatgagattccgggttttggaaaatgtattagtttttgagagttgatattgtgtatgccgagcgacatttttaaacactggtttatttcactatttcgatttttaatttcttccgcaaattgatttattttctgcattgttaagcttacctagtcgtagagactaggtgccgtcacgatggttcacggagggcgaaccagggtcgtaacagattctcttcattgcttgcactccgctcattttgctctattcttcgattcgtatcttgtataccttcgatggtataagagaaaagtataaagacaatatttgtgttaattaactttttaagaagatatattcaaaaaagcattaggcgcgaattataaagtctcatttgtcgaatgcgattataagtcgcaggcaacatgattcactctgttgctcgatgatttaaatctcctcgtatgctaactccttatgtatataatcaacgatttttaatttctttactaaatatattaagttattttttttctcttttttagctacatataaattccccgaacaaaaatgatttcagaagtatttctcctctgattataaccccttatataatcaacaactgtctatctttttgatgaatataaaaatttattgttgctcttggataaatatagtttcaaatgtgttaaatattattttatcaattgaattttcttaggccattaataaatgtatgtatgatatattgaggaataattcattactatgtatattggactttttgattttggtcgctttacgtgggctgatccaacccatgtaaaagagataagagaattatctataaagaaatttactgcacaataaaagggagaaaaatatgaaagagtgaaaagttgtttttttcagaagaaaacggtatcttttcttctttaaaaggaaaagtctgcataagctttcaaatacaacttcaagagacagaaaaacttcctcttgaattctcccataaacacacacaaaatctaggatatttagttcgtggataaaactttgttttcaagagattcagagtacgatttggggctattattttggtagtgagtttaacaaatcttctactgtgttattgataggtacgctattgttgttctcgccccgcgaattattctaacaatggcattagtgcctacgtgtttactcctagttgctgccaccatgatatatgcttcgttacagataatctttgtttggtgtaggcactgattttctttttggccgctcaaactggataacctaacaaattgatgttaaattctttgctgaggttaccgactaagaaggaaaacaaaagacgttgtcggggtttataatgatcttcatagatcttgtatatattttcttttgacaagtacaattgttctatagaaaatagatttatcagaatgatatccttttataaacaaagtatgtcatgtcagtagaaatttcctacatatcaatctaatgatgacaatgtcatgagcatattaaaagacatatgtagattccatgaatttgctaaattgtctttttgttataatacaagacacaatactactttcacatttttttggaggcatttggatagccccgtagaattttgaccataattaatttggttagagaagtatcgttggatataaataattttttttccaaatgaccatactttatttgaagtgctatagaattcaattacgtaaggaactatggttaacttgaataagtttccttaatgacattttctttgtgtgaaccgtgaactaatataaactgtccttaatataacttaatatctccttaatatagaaaattaatttagccctaatcccttgcattggcatacttctacgagttattgtgacatatattgtcatattgaatggttatagccattcttattgtttcctcggtcctatttcagatatgactgaacaaggacaagttcgaattactccaaatgagagttctcaaagtcaaggaaggagacaacgtagaaggatgcatcgtcactggacttatttctataatgattcaaacttagaacctgacgtcatcaagaatgtctcgagagcgatgcaaaatgagttatgggatcagagggctaagcgaaggaaatgaaaaaagaaacttagggagtctatggactttaaaatgggccctgatgcttccatttctaaacatgtgcacatttttcagttaaaaaaagctgaattgtctagttacatagagattacttattgaaaaacattaactattttagcaaactctcttcgagagccttggggtgaaattttaactgagatttatcatgatatttggcccaatgcaccttttagcgtatatgtgcaagagttagtattcaattaatacatggatgtcctagcaaacatgtaaattgttattatatattttattttaatgaaattaaattatattatttgtctcacctattacatatattatttattattttattttgcaatggactgactttaatattaattaaaatatttggatatagatgataagtgaaaacgtaatgaccttttgattctatattaaatgtagagttagtattataattaatttacttgagtgtgtaatcacatgcataaattaattgcaatatatattgatgagttaaacttataatattgtttctaataacagacatgccatcgaaaagtatcattgctaacttaaataagggtgacaaactgaatggtgaaaatacgacatctggagttgtaaaatatggtatgtactcgaagagcaatatgctcttgaaattattaaccatgttatgagtcacccagaggagggtaatattgcccaacacaggagggatctgaaaacttacaatatttggaaaaataaagattccactgcatgtgaaattattgtaagttcagttactgatgatatcattcatgaatgtgagcaatatcctactactcaagccatgtgggcacatttaagagaggcatattagggtacaactgtgaatcgtcttcgacagttgataatcaagtttgacacatacaaaaagtgtcatgatcacagtgtcaagtaataactaaaggtgatgtcaaatatgattgctcaaatcaaagtgctggccatgttctcagagatgagaaacaggttcatgcagtgattcagtctctcctaataattgaaaatatctgaaggttagcttgacccacaatgatagcattaaaacttttgttgattgttgcccgtcatgtggagcttgaagacaagcggtttggtgctgctaaagctgtacctaatgcctttgtgacataatcaagtggtacaaagagatcatgtcacaaccccagtttgccctccatgacttgtcgtaacggcacctagtctctacgactaagtaagtctaacaaatgtggaaaataataatttgtgaaagaaataattgaaaaccaaaataaccgaatgaattagtatttaagatgccgctcagcatatataatacaactctctaaactaacaacattttccaaaattcggaatctcatgaaaccacaagcctttgaatgtttacaagtttctaactccagaatgtctaacaaaagtaagcacagaagggctaatacttaaagagagcatagaaagggactcatcgttctgcaaacgcgacagatatacctcgaattctctgggaaagtcgcctcgcctcaaaggtgataagactgagtcgaagtacctgtatctgcacatgaaaaacaagcgcagaaagggcatgagtacaccacagcggtacttagtaagtgccaaacctaacctcgatcgagtagtgacaaggaaaggcagggccctactgagattaaataaaatataaggtaaaatagtataaaatgagatagtataactaaatgtaacagtaagaaataacacataatagaaggaacaacaataactataatagagacaaacaatcacagaaaaagagtacaactcaacttagagataacaaccggggatcttccaggataccgtccttattggcccaagaacaggtgaagtacaatcatgatcaacctgtacctatgagatgcacgtgaaggagataaatctaaattatcaagaagtaaatctcccgatctgattgaaaaggttgcatattggataaggagaggaagactccttatatgaagagaacacagtttaggaagatgatagtgttagagtttgagatcaacttgaactcttctacgatagaagagtagcatctgtatcccagtcaatctctaattactaacctattaaatgtcagtgttgtttctttttacaggtaatgcacataagcagaagttaaacttaaattgagagcaaaagagcaagcgattttgcaagcaatttatgtgtgattaagagtgcaatcctgaagctacttgaacaagatagaaaaaaccagttccaagtgtctatcttttatagttcaattgtagtaggtaattttacattgtacctttcagctttcatagaagcaattgtattaggtacctagagtgttcaagttagggttaacttgaagttgtcgcaacagttgaggctatgtgccacaacatgattagagttaatccttaggtttacaaagatttttgtaaatgctgttttagctcagtgattttagtggaagtttgggaaaatcctactgagtaataggtcgtggttttttcaccttttgagccaggtgttttccacataaaaatctctgtgttctttattttctttacttattattccgcaaacagtagtagttggcacagatagaaaaaccaggtccttctttagtttagttaagcgaaaattgagtaccacacaaatcacccccctcttatgtggtattgaagtctaaaacattaattggtatcagagcattttgtccttgaagaggttaacaccttaggaaaagatcaagatgagtgcaccacctggaaactgggaagggcaatccactgctaggccttcactctttaatggtcagtactattattggtggaagaacaggatgagagatcacatcatagaagaagactatgaactccgggacatagtcactgatggtcccctgactactacaaagaagaacgctgaaggagtggatgtgccaaagacaagagttgactgcgctgctgaagacttgaagaaatgggaaaagaatgccacatccaaaaaatggcttgtgtatgaactgggtccagacgagtacatcaagattcaaagctgtaccactgctaaggagatatgagacactttacaggtgattcatgaaggaactcctcaagtaaagagatctagaggaacactactatattctcaatatgagaatttcactatgaaggaaggagaaagtatccaggagatatacataaggttcacaacactaacaaatgaacttaaatctcttgggagaattatccttgaagaagacaaggttgaaaaaatcttaacaagggtcttaccagtaacttggaaaagcaaaatcactgccattcaggaatcaaagaacattgctactctcaagttggatgaactgattggaaatctcaatgcctatgaactaagaaggcaaaccatgaaaatggatgcacccaagaaggaaaggagtctgcctcttagaatagctaaaggtgcagatttggaggacgatgaaatggccattatcacaagggatttcaagaagtacctgatgagaggaaagggtccttcaagaggtactaccttcaacaaaccaaaggctcttgagaagtagacaaacgagggctgctacaaatgtggcaagactgaccacatgatcaagaattgtcctcagtggaaaatagaatggaataaggaaagggctgaatgaaggaacaagaagaaggaacaggttcaacccaaaaggaacaaaggatcaacaaaagctatggttgctgcttggggagaagcattagataaggattcagaagatgaagctggagatgaacaagcacatatggccatcggagaattagataatgaacaagaggtaagtgtgattcatctcaaagacaagattaaatttctgtctaaaaaaagttatctgaactatttctagactttattgatgagtctaaggtaattaacaatgagaaggaacaactgtctagggagtgtgtgatcttaaaagccaagtgcaaaaatctagaatctagggcaaatgagaatgacaataaaaatgctaagttgaagaaccaggttcttgaacttgacacaagtatcttagaacttaggtctgaaaatttaaaaataaaattaggaacaggtaagaagaaatctgatcacacacatctcaccttagaagaaaatctaggaaaaatgaatgatgagttgtacaaggaaagatgagcagataagagtcttaaaagaagacctagggaaggtaaagcatgaactagacagaatttgcaaatggaataaggcttctgatgcactctcatggttacaagaacaccacaatagcaacaagagaggacttggctatgggacccaagcacctaagtgggaccccaaaaataagtacatcactcttcttgagaacaaaatctgcacacactatggcaagactggtcattacaaaaatgaatgtaatgcaaaagaaaaggccagtcaaaataaaataggctgcctgggtgggcctaaaggaatttaatttacccatttgcctatagaaagagacctaaactagtttgggttcctaagactaacccctgatttctttttgcaggtccaagtgaagggaagtagccaaatatggtacatggatagtggctgctcaaaacatatgactagaagcaagaactagttcctttcacttgagaacttaaaaggaggtaatgtctcctttggaaattggaagaaatgtgagattattggggttggaaaggtaggtaagacagactcacactccattgagaatgtctacttgatagatggcttgaaatatagcctaatcagtgtatcacaactgtgtgacagaggtaaccttgtagcatttacctctaccaaatgctttgtgattaatcttaccactgacaagattgttttgcagggaaaaagagttaacaatatttacattgtagattcgtccactctttcagaaaatgaactcacttgattgagtgtgttggacaatgatcccctcctgtggcacaagagacttggtcatgcaagtctgaattaactcaacaaattagtttccaaggacttggtgatagggttacctaacatcaagtttaaggaagacaaaatttgtgagacctgtgcaagggggaagcaggtaagatcatcctttaaaagaaagaaaatggtaagcacaaccaggatgatagaactggttcatatggatctctgtagtccaatgagaacattgagcagaggtggtaagaaatatgtgatggtacttgttgatgattattctaggtttacctgggttctattcttaacatttaaggatgaagcatttgacatgtttactgcctttgttagtaaaactcagaaacaactaggtaatcaacttgcatcaatcaggtttgatcatggaactgaatttgaaaatgctaaatttgctgaattttgtgatgagcatggtatagatcataatttctctgtccccaggactcctcaacaaaatggagtagttgaaagaaagaacaggactctagaatatatggctaagactatgcttctttctagtaaactgccccataacttctgagcagaggctgtaaacattgtatgttatatcattaatagatgcatgactagacctcttgtatagaagactctctatgagttacttaaagggggaaaaccaaatatatcccatcttagggcatttgaatgcaagtgctttgtgcacaataatggaaaggactccctagataagtttgattccagaagtgatgagagagtattcttgggatattcttcatatagcaaagcttataaagtgtttaataaaagaactttgtgtgtagaagaaagtgtacatgtagtttttgatgaaactaacattctttttgagagacaggaacatgaagatgaagctattggtctggtaaaagatttgagtgaagtctcagctcaagctaaagtggcaccaaaagaaggagtaggtgatggaacatgttcttccatccagggcaacttggtagggggaactgatcaaagaggaactgaaatcaatcccctaaaggaacctgttcatgaccctgttcctcagcaacagaacatgggaaaaacatcaagtagaaatctgttggttgtgaaactgcacaaatatcaaatttctcatcccattgagaatataattactgatccaacctctggagttaaaactagatcacaattaaagaatctgtgtgcttttgttgcttttctatctattattgaacctaaaaatattgttgaggctttgcaggatgcagattgggtaagtgcaatgcaatatgaactcaatcagtttgagagaagtcaagtttgaaatctagttccaagacccaaggacatatcagtaattggcacaaaatgggtcttcagaaacaagtttgacgaagatggaacagttacaagaaataaggcaagactggtggtccaaggttatagccaagaggagtgtatagattatgatgaaacctttgctccagttgcatgactggaggcaataagactcctcatagcctttgcagcacatatggaattcactcttcatcagaatgatgtcaaaagtgccttcctgaggggctacctaaaagaagaagtgtttgttaaacaacctccagagtttgagagcgaggaatgtcctaaacatgtgtacaaattagacaagactctctatggactcaagcaagctcctagagcatggtatgaacgattgtccaaattcctgcttgaacatggctacaaaagaggtaaaattgacagtactctattcttgaggggaaaaaggtaaggatcttcttgtggtacaaatatatgttgatgacataatttttggggaaaccactgacaaactaagtaaggattttgccaaattaatggggagtgagtttgaaatgagtatgatgggtgagcttaactttttctttggcttacagatcagacaaaacccaaatggaaccatgatccatcagcagaaatatgcaaaagagttgatcaaaaattttaaaatagatgaatcaaaggaaatagacacccctattgcaattgccactaaattagacatagatgaacctgattcatctgttgatcagaagttgtatagggatattattggtttacttttgtatcttactgccaacagacctgacatagttttcagtgtggggctttgtgctcattttcaggctaatttagaggaatctcacttgactgctatcaagaggatactgagatatttgaaaggcactactgatctgtgcctttggtaccctaaaggtagtaatttcaatctagtagggtatgctgatgttgattatgcaactttccttgtggataggaagagcacctcaggtatgactcattttcttggttcatgtcttgtattatgggccactaaaaagcagaattcagtggccttatccactagtgaggctgaatatgttgctgctgcctcttgttgtgctcaattactgtggatcaaacatcaactgatagattttggcattgaagttggttgcattcctatcttctgtgataacactagcgctataagtatgacaaagaaccctattcatcataaaaggactaagcacatttatgttagacaccacttcttaagagataactacgaaaaaggattgatctccatagaattatgtgctactgataaacaaattgctgacatctctactaaagaactgagtagagaaaattttgagaggaacaagttggaattagggatgattaagatcacctaatagtaccagctcagaatgcacaatgaaaaaaaaatgatgaaaaaaaaatatgaaaaatgaatatttttttgctaggaaatctgaactagtgtaaatatctagattaagttttactcagcttcatactgtaattagtatactcctgtgacatgtgttaatatgactgactgatctcttacaaaattttctctattatggtaaattgaggcatgctcaagagaattctaaatgaagaacctggttcatcagtatgagttcatctgaatgctgaggtatgttttctatactctgcacaattagaaataattttttttaaatcatgagcagaagtcctacaattgttcaactccttagaaaattctatcagtttgtttttgaaccagttccgtcagctttagaactctaaaccacaaaaactgatctagagaagcctaaccattcattcaaacctaaaatttcaggttgattagacctctaattgaccactgctaaagttgctgttaaacattcaatgtgtatttctctttaaatacacatcattacctccttccatcttcataattctaagccgtcaaaaacccttcttcactttcaattactttcttctccaaagttctaactcaccaattctctcacgaaatcagcgataatgacaaacccacaagattaccctagaattcctcgactacccactccctcaaattcatctacccttcctccacctagcacatctcccaaacccaggttgagaagggtaaaaaatgcttgctcgaaaaacagtagcttctagggctctttcaaagaattgaatgagaaattaaaggcaagtaagtccaagactctaactccaactttgattctgagtcgtacaagtctgctagtgagggggaaggacctgggtcttctgactcggagaaggctcaagaatccccttctaaggtaagttcttttttgactgagaatttagaaactaggtttgttttggttaggcctatcagggatgtggaattacctgagttacgaaggagtggaggtaagaagaaatctaaaaaagaaaaagagagagagagggtgcatgtggtgacgagaggggaaaaagggaaagggtggttgatcattcaaccactaatgattagtctgtacctgctatctatggggttgaacaagaaaatgttgaagaaagtggcaagaagtcagggggaagtggttttagtgaagctgctgaagggttagttaatctaagcgcctaaggagatgaacctggttcatcaactgaagagaccctagcagacccgttgaaaaaggttggggcaagttatgatccaaagaaaagaaaaactcctacaccaaaagcccccagtgctcctaaaccctccaagaaaagaaaggctttatccccaacaactactgaaatttccttgccaaagggaagagccacaagaagtagggtgaaatagagtgagagtgatctacaaaaggctctggttgagagtaagaagaaaaggatggataaaggaaaagggaaggttgcaaagtcctcagaagttgtggaagttgcagagatggaacaggtccatcaggagacagttacaacagtggaggttcagacccccaaggccaaaattcctaagacttcttctaagaagtcttcctttgtgtctgaggctgctgaaccttcattagccaagaggacaaggtttgcagtaaaaggtaaacaagttagaatttctgaagatgaggaatagagtggtgaaaaagaagaagatgagtctgatggtgaacaagacaagcttgccatgtttggcaaaagaaaaattttgaagggtagattgctgaaagacctggtggagctaggaatgatgagactggtagatgccttagctgctcagggctggaaggacatggtcctttagatggatggaatgctagctaggaatgagatcattgagttcatggcaaatgcataggttgacctttgatgcaaagaagctaggggagatacttgacataccctctgaagggtttgatgactatacaaggcaaaggtggccatgtctggactctcttcctactgcccttgaaattaccaggaggttctgtgatgctgcagatgtgaatgaggctagggctgttcagaagagtgaaatgagaccacaacacaaagtcatttttgtgtttgtcaacaagtgcctactgcctaggcaggagagaaggcatattgcaaattatatggacttaattctgatggagtgcctggaaaatgaaaggcaaattaattggcctgcattcatcatcaagctgctggacagggtcatcaatggctccaaggctcatgctaccccctatggctttattctggctacagttctggataggtgcaatgtgcctctgaagaaatgggaaatgacctcaagaaaggaccactttggcattaatattgtgcttgcttgtgactatttagtcaatgccatcccaaatgaacctggttcatccaataagactcctatcaatagtaaagtcagggctcttgttcaggaaagtgaagccaaggatgctgagatagctaggctcaaggatcgtgtgacagaggtagaatctgagagggatgctctcagaactgagcttaccaaggaaaaggagaagaatgatggaattcttcacaatatgctgaatcttctccaagcccaaagccaaccctctagctcccccaagccttaggaattctagcctttgtctcctaaacctgtctagtaccttcagtgacccggattaaggatttttctttctttttgctcatggtttaaatgttttttttgctttctggttgtggattgtggtagcaacatatcttctatcaatgatatctactgtttttgctcttgttcaatgttaatctttccttgatagtttaaatatttttgcttgattactgatgattaaaccatgattgcacttgcagttgccccagtggccatgagtacttattaaaatgtgggactcacactttgtatgcaacttttcgatgatgataaaagggggaagagatattgtgctttacatattctgaataagtgatatttataacctaattaacctggtccttgatgataagtgaattgtctaaactttgtattgatggttaagctgagctcttacaggatccaagtaagtaaaaagcacagagtttgtcatcatcaaaaagggggaatttgttggcccaagaacaagtgaagttttgaagtctgacaaaagaactcagacatggaccaggtctatcttgtgaagcacagtcatgatcaacctatacatatgagatgcacgtgaaggagataaatctaacttatcaagaaataatatctcccgatctgatcgaaaaggtttcatattggataaggagaggaagactccttatatgaagagaacacaattttggaaaaggatagtgttagagtttgagatcaacttgaactcttctacaatagaagagtaacatctgtatcccagtcaatctctaattactaacctattaaatatcagtgttgttctcttttacaggtaatgcacataagcaaaagttaaacttaaattgagagcaacagagcaaggcgattttacaagcaatttatgtgtgattcaagcgtgcaatcctgaagctacttgaacaagatagaagaaccagttccaagtgtctatcttttattctagttcaattgtagtaggtgattttacattgtacctttcagctttcatagaagcaattgtattaggtacatagagcgttcaagttagagttaacttgaatttgtcgcaacagttgaggctatgtgccacaacatgattagagttaatccttaggtttacaaagatttttgtaaatgctgttttggctcagtgattttagtgaaagtttgggaaaatcctactgagtaataggtcgtggttttttcaccttttgagccaaattttttccacgtaaaaatctctgtgttttttattttctttacttattattccgcaaatagtagtagttggaacacatagaagaaccaggtccttctatagttcagttaagcgaaaattgggtaccatacaaatcaccccattttatgtggtattgaagtctaaaacatccgtcctatagtcccaaatatacatttccaatagatatgccgggataccatcccgtagtccaactcatagtgtgcggggatatattggaatcccaatccgtagtcccaaatgtaaatacctagtactgggggaatctaccgggtgcagtcccgtagttccatataactgtgcagggagatctaccggaatcccacatccgtagtccaaaataaatagacaaggaggatctaccggaatcccacatccgtagtcccaatgtaaatgcacagcaacaacatgaaaaatattcagcaaatgtcaattttatattaaggcaaacaagtaattctagcttagcatgctgcacagatttcaggtaaagcagtttgagcaaataaagcaattaaatcacttagacatgcttccctaagtcaacaacatgctaaaattgcaagtagtaataacaggaggagaaacacaattttaattacttagtgaaaaccggattttcaacaattaacacaagtacgcactcgtcacctcacatacaaggaatttcaaatatcaacaatatcaaatcctaaggggaagtcccccacacaaggttaggcaagccacttacctcgaaccggctcaaagtcaacccgaaaccacgttcttgccacgagtactcgactccaattggacaaaatctattcaattcaattacataatgtaaataacacttcaagtaactgattctacaacgaaattctaagctaatacgcgaaagtaggtaaaatgaccaaaacgcccctcaggcccacgtctcggaattgggtaaaacttacattttcagaattctcatactctcacgagttcatgcataccaaaattatccaaatctaatgccaacttcccaatcaaaactcgaaatctaggtctaagaactttcttccaacttttccccaattttcatctccaatccgaaattaaatgacaaaactaagattagattataagcatgcaactagaaagggattaggaatcgttacccactaattttcccttcaaaatcctcccaaaatcgccctctcccgagctccaaatcgattttccaacttctaaaactaaaccctcgaatttctgattttttgcccagcaaacccgctccggtccaccaatcgcatcttcgataccacttctgcggttctcacttaaaattccatctcctcacctgcgacccatatgccacatctgtggtctcccatgtgcgctaacccatcgcttctgccgtccctgctctatttcctcttggcctctcaaccgcaccgcagatacggttatgacagcaacccaaagaacttcagctgcaaattccaaatttccaacttcccgttaaccacccgaaatcatcccgaggcccccaggaccttaaccaaatgcacaaacacgtcacataccactatccaaacttacacaaatctccaaaacacctcaaataacatcgaatcaaccaattagcctcggattcaagtctaagaacttcaaaaactcttaagatatgctttcgatcataaagtctatcaaacctcgtccgaatgacctaatattttgcacacatgtcacattcaacacctcagagctattcaaactcccgaaattccattccgaccctcggatcaaaatctcactatcgaactggaaacttaaaaaattcaactttcgacatttcaatcctaaattagctacggacctccaaaacacaatccgaacacgctcctaaactcaaaatcacccaaagagataatggaaccaactgagttccatttcgaggtcgactttacaccgttctgactacagtccaaattctaaaacttaggctcttatttagggactaagtatcccaaaactcttcgaaattccaaataactcctctcagcaactcacaatatcagaaacaaacacgaagaatgcaataaatagaggatcagggcgtaaattcttaaaacgaccggccgagtcgttacattatcccacacttaaatattcattcatcctcgaacgagcatagaggcatcctaaagtagtgaaaagatgatggtaacggctacgcatatcctgctcggtctcccaggtcgcctcctcgaccggctcgccctgccattgaacatctactgatacaatgttcttcgacctcaactttcgaacctgcctgtccaatatcgccacaggctcctcaacataagatagatccttgtccaactgaactgaactgcaatccaacacgtgcgatggatccccgtgatacctccggagcatcgaaatatgaaataccggatgaaatcctgccaagttgggaggtaaggtaagctcataagcaacctccccaacacgtctcaatatctcgaaaagaccaataaacctcggactcaacttccctttcttcccaaatctcataacgctcttcataggcgaaactcaaagcagaacccactctccaaccttataggaaacatcacgaaccttccggtctgcgtaactcttctttctggactgggcttacggagtctatcttgaatcgccttaagcttctccaaagcatcctgaaccaagtctgtgcccaataatctggcctcacccggctcaaaccaacccaccggggatctacaccgcctaccatataaagcctcatatggtgctatctgaatgctggactgataactgttataagcaaactctgccagtggcaagaactaatcccaagatcctccaaactcaatcacacatgtacaaagcatatcctcaagaatctgaatagtgcgctcagactgtccatccatctgagggtgaaatgctgtactcaacttcacccaagtacccaactcatgctgaacgtctctccaaaactgtgatgtgaactgagtacccctatctgaaatgatggaaacttgaataccatgcagatgaacaatctcccggatataaatctccgccagatgctccaaagaataggtagtacacacaggaatgaaatgtgtggacttggtcagccgatccacaatcacccaaatggcttcctcaaagtctgtgggagcccaactacaaagttcatagtgatccgctcccacttccacttcagaatctctatctgctgaagcaacccacccggtctctaatgctcatacttcacctgctgacagttgaggtaccaagctacaaacccaactatatctttcttcatccacctccaccaatagtactgcctcaaatcctggtacatcttcgcgacacccagatgaatggaatatcgcaaactgcgggcctcctctaaaatcaactcccaaagcccatcaacattgggtacacaaatctgaccctacatcgtcaataccccgtcatcaccaatagttacatctcttgtatcaccgtgctgaaccttatatttggggaaaatcaaatgggggtcatcaaactgatgctccctaatacaatcaaataaggaatacaaaccatgcaagctagaacccgactgggctccgaaagatccaatctcacaaactggctagctaaagcctgaacatccatcgccatgggtctctctactgctggtaaataagccaaactccccaaactctctgcccgacaattcaaagtgtcagccaccacattggccttgcccgggtaatacaaaatagtgatatcattgtccttcaacaactctaaccacctcatatggcgcaaatttagatccttttgcttgaataggttctgcaagctccggtgatcagtataaatctcacaaggaacaccgtacaaataatgacgccagatcttcagggcataaacaatggcaggtaactcgagatcatgaacatgataattcttctcatgcacctttaactatctggatgcgtaggcaatcaccctaccatcttgcatcaaaacctctccaaggtcaatcctcgaggcatcacaatagacagtataagaccccgaacttgtaggcaatattaaaactggggcagtagtcaaagctgtcttgaacttctgaaagctcgcctcacactcttctgtccactataagggagaacccttctgggtcagcctagtcataggggctgcaattgatgaaaacccctccacgaaatgacggtagtaactgtcatgccccaaaaaccgaggagcgcgaccggcgctcaaccgagtatacccgactgagcaagtctgctaggtttcattctacccaaactaattcacgaacaagtaggagatggactccattaatcatacttagtaagtatttcattatcaacttccatttcatttccattagcaacttaaatcataattatcaaaatattacaagttttataaatctttaccaaacatcaatatttctactttaattccaatacccgacactacccacaacctgtctacagagcctctaaacacaactgaagagtaatataatatggaaatgccggtaacaaggccccgactatacctccattgcaaagtacatgatgaacagatgaaataggaccccgagagagaaatacttagtaacttaattatatcaaatacaaagtacatgatgaaatacttagtaaatatttcattatcaacttccatttcatttccattagcagcttaaatcataattatcaaaatattacaagttttataaatcttttccaaacatcaatatttctactataattccaatacccgacactacccacaacctgtctacggagcctctaaacacaactgaagagtaatgtaatatggaaatgccggtaacaaggctccggctatacctcaaatacaaagtacatgatgaacagatgaaacaggaccccgaaacgaagtggggctcaccaagtcagctgaaaggatgatgcggcactagctgcgaccaacactgcctgctataaaaacacctacattcatttaaagatgtagcacccccgacaaaagggacgttagtgccatcgaatagcactagtatgtataactaaacaccatctagtaagaaagaactttcatacgagaataaagaggaaatcataaagacaacaaagtttcaaataagcaccatgccaacaatataaagaggttcacatgattttcacatagttcttgaaattttagattggagcatcccacactgttgcatcattatccatattaccaccacttccgtgagggagttagatcacgacccgatcggctaagccgtctccccgatatgttaccattattttattcacactttccagtttcattcatccatacattaccaccacatgtatatatatcatggagtccgatcatggcctgatgggctaagccgtctccccgagacgttaccattttccatcaatcatctcaattcgatccttgtttcacatatatcatttcataggtacatggggccacaactatcacgtcatatatttggcactaggccacatttcacatcattcccaatttcaatgttagatttgtgatttaggatgatatgtgtacacaagggcaaataaaattgtaagcatagatgagacttcacatagaggacacaacatatacaacttcaatcttaatttaaagtttaagcatttcaatacatgattcatattccataattaacgtttcacattgttcccattttcaacctttacttttgccacttaagatcataggcgcatacaaaggcaaattaaatcataagcatagagagaaattcgtcaagtttggcatattagtcccaaagtaaccttggcatgacatttaggcatttagcacatatcatgttctccacacatcctcaatttacaaagaataacacattaaacacatgaagaagtacctaccacatataatttcacaataataatctacttaacacaacaagtactgtatcaatcacgtttcgaacttacaacatttacacgggcaccatggaagttcaatttctaagatacggggttttagacatacatacctcaatggagctttccttaaatctctacaatacaccaacacctctagtattaacaatctataaggagatagcagaaatcgattaataattggaagattgtccatggtgtaactctcttaggaatttcatcaaccacctaacatgtgaagtagactacaaggtttagaaatggcaattccttcctccctcaaccaattttaacatgaactacccatattagttctttaacatcacatactacaacttagtcccacatacatggcctatttctgacccccacaacatatttgaacctttaacctattgcatgatgttttggaagtaggacttatccggatggaggacaatttatggttatcttccttgattcttaaagacttgagcaagatttggatgattatgaagttaggcccctcctttatctctctatgtgctctcatatctctctaaatcagtagaaaatgaccccaaaatgaaccccaaagcctatatattaaaatgaggtcgggttataaaaataggaaaaataaccctccgaaactgggtctgcaatcacagaatggaccgcaaaacaagaatgtgggccatagaatgcaccacaaaataggtgcccaaaactgggcaacactggcccaatttacgacagatctgcgatcgcaaagtcaaaaatgcgacagatttacgatcgcagattcgacacaggatcacattttttcagcctttggtaattggatcataactttgtgtaggaatgtccaaatgatgaacggtttgaagcgttggaaactagactcaaagtcctttcatgtgataggttgttcatcaaataaaatctaatacatatttagatatgcttgttcaaaatgtggtcttatgtaaacttagttggaatcttagcctattatgaaattttccaatgtgacttaggtttaggcctttctttgggccccaaattacttaccataagacttgtacacttatttaccaaattcaatttatgcccaccatgttaatagcacataaaatattataattagcctacgtggcatcacgaaatcctagattacttagcgaaattttccggggccttacattctcccccctttaggatcattcgtcctcgaatgaggagtagagcctggcccaaatacctaacataacgtatctcttttctacaatttttcagaaatttcggcagcatctcctttgtaactaggcctatccacctgtcagagaatcacccaaaaccatcctaaaactcatccataactcgacaaagcaccacaatatatatattaataacataaaccagcattacaagcactacattatcatgatgatacctggacatggattgcacatttttaaatcataacacatagaaggtacttttcaaatcaaaaccaattgttatacaatcaagagaaaataccttatttccacaatactcttggccttcaatgtgtcctcttatacttataggctcttctgtaaaacattcacgaaaacaaccccaacctccaaacttatctaacaatgatgacaactagatacctcgcataagctaactatctattaacattcaccttcaataattttcaccaggatgatacacaaatgatatccacctaccttcttagacatagacatatgaaaacaccaatttatgaggaccaactatggggaaacatcatactcctagtgcgacctaatgggaaatgcgcttacgtacccttcatcatcaactcacataacctctacaagggagaattttgagaataaccgattcaccctcctgaattctaaatctctatgcgaacacctaaactaaactcgtggtgaccttcacgattactctaagatatgctataataaatttaccataaaattacctattgaatatatgtgatcacaagatgactttgacacgtttgaaacttcaataccaaatagatctaatatagtaaggagcaatagagttcaagattgggatggaattatttaggaatccatttatgcgctgagcagagtatttcatgaggttacatactgagagacacgaggatttatattaatgaggctgacatggtttaatccaggtgactacatcaattatcaaatagatgaagcatagtggtgactaatattcttagataaggtggataccatgtatgtgaacttgagattttaaaaaggtgatcaagtaagatgcaccagttgtatccctgagcgtaaggtaagtagttgagttcaaatggtaagactcttgaaacatgggtgtgattgaggcagcaaatgaaatacgtggaattttattttactcctatcaataaacgactcaaagactttatgccacaagcgcatgaggatggaaaagaagtcatctacttatgagatcatcataattcgaacaatctaagccttcctaaggtggtggaatgccagaggtagcaaaattcccatacatgacaatgacattgtcaatactcctagaagccgagtgagcatagagccacataacctcatcaaatccgacccattcatgacttttctgaaaaggggacacactttggtttgaaatcatggcaatttaagcttgcactttaaggaaaatcattacttttaaaacccatgagacaagccctcgtagtcctagagaatcgtcaacaatggcaagaaagtacttaaaattattacgagctggtatagaataaggcctcgaagcgaccatatgaataattatgaaagggtgagaagtcttgatgcacttatcgaagaagagtaacctaagttatctagtcacatggacaagtagagcaggtaaatgattgtttaggagaaaatctcataaggagtgcgagtaatatctttttatcctaacaaaaggagcataccccgacccttgatgccataaggcataaaattagattcacgaggagagttactagatgaaaatagatagtaaggcagcacaactaagagcaccgcttggaatcgacaagcttaaacagagttgaagacattagaagtctgtaaaaaaagggaaatttgcccactctctgggcacttgtagagtacataaaagtgaggttaattaaatcagatcatatagttggataactaatcgagacattgagataatatcgcattgaatattccgggaaaacaacacataatgcaagacaaataaaaagaaagtgagagagccttatggaagtaacctttacattgtaaccactaggaatggtggtaatataaagcgattacgagaagctacatttttgaaagaagatctctgtatgtagtcacgcgatgtatagttccagaattcaaaaatcaaattatgtttagcaactctatttcacaatgaagcactatagcacacttttacacaaccaactattaccaaccaaattgggaaacactatacgaggtaccacatgaccataatagtaaggtgtataaagtatgtgaaaagtgagtagtattttaagtaaatgggaataattctcaattatgcgggtaatagattaattaccgggtaacgaaacattacccggttataactaataagtggataaatttaatcaattatcctaaagagtaatttggcagcatgccacacattaaaagaatgactcttcaagtcatttcaatatgtgacagtgtaacataaagtcatttaatgactcataaggaacatgaaagaacaaaaaccaaaatcggattcttaaagtttcaaaaagaccttttgtctttagaaaccaaacaaaaataaacgtgagtgagattcttaaggaactaaaaacttaagaattagatttttcaaaatttcaaagccaaaacgtgaaaccaaacaattgcatactgtcttgaaccaaaaaatcaattctgtcaacacttcaaaaatttcgattgaaatttcagtccaaatttcaatccaagcttcaagcataggttttgttcaagaatttcgcagaaacgagtatgttaagtctaagctcttctttcatttggcatgatctcgtcattacattcacatctcggaatttacgtatattttgctagtcttgcaaattgcgtataattttctagtgttgtaagttataatattctccttatcgggatttcatattcagttgagtatttccttcttctattcaagagtgtagagaacttacatatatatagtattaaaagtattttcattaccatcgagctataatcgatgggtaggcccctactaggaaacctctgatcagatgataagttatatgacgatcatactgtggccgagcgcatatgagcgagcccagttggtcgagatacatatcctagtatggccgagcacttatgagcgagcctactatagcagagcagatatatatgtataccgagccttatagggccagacaactattttacttactatattgagagaattgagtcagtatcaacaggtaaacatatcttcagattatctttgacttccagctacttgcagttattatattatcagttcaattttagctttcagtatattgccttacatactcagtacattatttcatactaacgtcttttttctgggggcgctgcatttcatgcgtacaggtcagacagacagatgagtaggcctcttcaataagtgttgcccgagttcagcttgattggtaatctccatacctttcggagtttacgggtctagagccttatgtatatcttgtatatatacatatatatgtcatgagtaggtcagatagccattctgataacattatatccattagtgaaggcttgtagacatatcttgtcagttagtgcagtatgttaggatttcaggccttgtatgtatatttggttggtttgtcagctgtaataaatatgacggccttgtcggccaacttttatattgatgtttagtcagcattcgctgtcgtcttgcaatgtggcccatggccaaaagtatggcatcatatgttcagagtcccttagttgtaagttggtacacaaggataggtgaggcattgggtaccggtctctccccccccagttcggggcatgacaaaagtggtatcagagcagttctgtcctagggagtctacaagccgtgtctagtagagttttgtttatgggtgtgtcgtgcaccacacttataagcaggaggctacagggcatttaggattgtcacgctttcttcttactctagaccatgtggtagagctcacttataagaattcaaattctgaaaatctattttattcgtaataaaacgatgcctccattaggaaagaaggttggaaagaaagatagttgtggaagagctgagtcagaggaactggagttttgtatgatgcgtacgataagtaaatatgaggtctttagcagatcatgagtgtactgaaaggtgtaagcttcctgataagaagccttaaggcaggaatgcctttccatctttatggtaaaggacaatgagagattaaagaagataagtacaagtagaagcaagtaaaaggagcaaggtgaaaaagggtacaatatacccagttaatgaaggttaacaacatttataattgaggcaaaggaacataagctttttgagttatattcaatagtaacagaggtatatataattggtcgcaccccttccagatatgccctatgggggttaacaaaagtagtataagaaaatatgatggatgaattgattgcgtcagttgacatttctgaaggatattgcaaatgtgctaatagatctctttatgagacacctagatggtgcactctaaaatagtgcagtcagatatgtgtactacaaagacatgcactataagacttgaagggataagtattaccttagtgtgtctcatgtccctagtaaagcgagaatgttaagcaacttgaacagccactggatggagcaaaggaaagctaaaagcgaaagaatgtcgtattgaagttttcacaagaaaaaagttatgcagaaatattagtagagtaatgagaagagagataaagaagcattatgaataaggtgtgatacatggagtaaaacggtagagtgttacaaaacctatagtcaaatgaaagaagagatgaaaggtgaagggtcttatgacaataaaagagtataggccataagattatatcttcatttcgagaaataatttcgtgactctagtgcgattgccaagaggaaaagttagaccccagagtagtagaaatcagtatgggctggtgaataagataaactatatatgaattagggaatgagtgatttggtaatatttagcatcataagaatttcagatcgcattccggcaataataggacggacaacagaagaaggttcatgagaaattcagagaatggtcattcaagaagacgctttcctaaagaaagcaatgttagcaaagttaagcctaagggactgtatgtaccagttacattaagtgtcaccctcacgagtaaggggatttgtcatccttggtacagaagggttgccgcaagacgagtaagtatcattgatgttgagaaacgacgccaaagatgaagaggtaaaacatctataggtagatcatcgtagcttcagctcttagtacacccctaaaagggggaatatggaatgatgtggtattaagtcagaattaagtggttctagtgactatggaatggtaaaggaagaatgcgataaatgaaagaggaatgagatggcacttatccaaatcttacagatacgctacaatttaaaaatattatgcaagcacgacatcaaggaaaggaagtaaaggttcctacccgaactgttattaataaatatagagccagtgcgagacgtaagttaagacaaatgaaataactcaagaaagattacaaggaatattgatatgagaatggaccaacgagtagttagtaattggtcaggaagatcccagttatggctaaacaggaggttacagacgagtcatcagaccgtgtgagataaacaaagtagaacccaacatggagagttaagcctcgaagaatattattattatacttgagatatattcaaacaagagtcggggtagctaaagataccgtatgagtgttaggggataaaagaaagtgccactgggaagacagtaaaaatatcagttcagaagcaaccatacgagcacaagggcatggaggtaagcaactacggatgattacaggcaagtaaggacatcaaaaagttctgcaataagcacacagctttaccagagtcaagggttatccctaagtactacaacgaaagactagctaaggaaataagaaagaaggcttcaacctaagcacaatgacctaaagaagaaatgatcgtgtaacaacaatctcacaacaacattgaaagcattccaaaggaaagtggcacctaccgtggctaatgaacgggaagtaagaattaaaagtaattgcatacgttttaagagagctgagatggaacgaaaggaattattcgatcaatgatccagagttagtacgttatggacatactcgagattttggagcattatacttgttggcaatcatacaaccatagaagactctgatataagttaaaaagaagaattgagcctagggcttagacaaatgattgaattgctaaaagattgtatcatggatattccataatgcccatgaaaggctaaggtaattaactgacaccatgagccaagggtcgaaggatagcttaagcctacgtaaaggctgatccgaaggaagaggaaactagaaaaatcacatcacccaagtaaatcaggagtctgattattggacctagaaaaattatagaagttgttcttgagaacatggtagaatcactcttaatatcagatgttcaagagaaataacataacaaccataatctataatggctccataagaaagccagttagaagaagtaccagcctcataagacgtcagtacgaagctcccatcggatagtgtatgtagcagaggtgcgagtattataatagagcttcatattatggacttgaattatacctatgtggaagggaggtcatgaaagagatagaagatatgatgctagattttaaggtaagaaaggtagaggtgaacaacatacgagatattcaaaggcaggatatgtgaatagtccatacttcggatagaaggctataagtgctgagattcaatatcaaggaatgatagcagcatagtcagtgacatatctcatagcctatggttcctaggtatcgatgaggctaataagacagtaaagaagagttagagacgatgtgatgtccggcttgatgtaccagaatgacataaagaaatatatgatacaagcaagttgaaaggttgcaagtaatataaatagagttgtgtaggtcacaagccattgtatggtgaagcgacaaggttctagaagacaagagtaaggataagaaagggcaagtgagaaggtaacgaaaatggataagtcctcaggattacacccatgaaaacaagaagaatagatggtttctctaaattatacaaagctcactatagcctgaataaactcaaaggagtctaagactaataacatttagaatgctaccctggtagtagaatgagagtgtaattgtgatagataaaagatgatgtttgggccttcgattaagtaatgattcaacaaagaaaagaaacggatcttatgaattggacaggattaaggtacccacacaaggtgaatcggattgggatgttgtgaggtacgattatgaaagcaggatatcgccccaggtggatcaatttaatcatttcagacgttccccgataaaaggtgaatcctagcagcaatattacataaaaggttaagttatcagtggtatattatggatcaaaattgatggataaaagttataaagtatgagaagagattaagccgtcattcttaagatgaacagtattgtggaagcattagaggacatagatttatacgtatgggataagcaatgaaagtaacctaggatttggtagcagacctcagtaatgagaagtcgaggtaagaattatggtatagtatgacctatgtagatgcagtacagtcataagaatggataaccacgtctatagaataagatatagcaatattcgtaagtttgacaaaaaaaagagcgaagaacttcaggattggctgaggaaaaaggaaaggagagtctcataagcacacttacatggtcagtatcgtagaagctgcatgatgggaggtagcaatagttatgagattgggaggaatttgatcacaagtcatgacatgggaaagaggcctaaacggggagaataccctagactttggacttattcacagaacagttgcctagatggcaagaggactactaaagtattcggaagacacaggctataaaaatgataagagcaccagtcaacattcgaggacgaatgttctaaagggggaatgatgttacatcccacatttttgtatgttaaagtttagtcgtaagttaatcaacgtaagttcgaggatgatattattttgagattttaagtattatgctatttcaaacaagtgataagtaaattcatgaaggtgagaggggaagcaagtcaaagaaaataaattttcgtccaagtttggcatgttggaataaaatacgacccgagctaaaatactcggtatttatggactagtaccatacgaagtaccacatgaccataatagtaaggtgtataaggtatgtaaaaagtgagtagtattttaagtaagtgagaataattctcaattatgtgggtaatagattaattaccgggtaacgaaacattacccggttaactaataagtggataaatttaatcaattatcctaaagagtaacatggtagcatgccacacattaaaagaatgactcttcaagtcatttcattatgtggcaatgtaacataaagtcatttaatgactcataaggaacatgaaagaacaaaaactaaaatttgattcttaaagtatcaaaaagaccttttatctttagaaaccaaacaaaaataaacgtgagtgagattcttaaggaacaaaaaacttaagaatcagatttttcaaaatttcaaagccaaaacgcgaaaccaatttcaaagccaaaatgtgaaaccaaacaattgcatgctgtcttgaaccagagaatcaattctgtcaacatttcaaaaatttcaattaaaatttcagtccaaatttcaatccaagcttcaagcataggttatgttcaagaatttcgcagaaacgggtatgttaagtctaatctcttctttcatttggcatgatctcgtcattacatttatatcccagaatttatgtatattttgctagtcttgcaaattgcgtatatttttctagttttgtaagttataatattctccttatcgggatttcatattcatttgagtatttccttcttccagtcaagggagcaaagaagttaaatatatacagtattaaaagtattttcattaccatcaaattataatcgatgggtaggcccctattgggcaacctctgatcagatggtaagttatatgacgatcatactgtggccgagcgcatatgagcgaccagttggtcgagatacagagtctagtatggccgagctcttatgagcgagcctattacggtagagaagatatatatgtataccgagccttatagggccggacaactattatacttactatattgagaaaattgagtcggtatcagcaggtaagcatatctttaaattatctttgacttccagctacttgtagttattatattatcagttcagtttcagctttcagtatattgccttacatactcagtacattatttcgtactgacgtcccttttctgggggtgctgcatttcatgcgtgcaggtcagatagacagacgagtagacctcttcaataagtgttgcccgagttcagcttgatcgataagctccatgcctttcggagtttccgggtctagagccttatgtatatcttgtatatatacgtatatatgtcatgaataggttggagagtcattccgattacagtatatctattagtaaaggcttgtggacatatcttgtcagttagtgcagtatgttgggcttttaggccttgtatgtatatttgattggtttgtcagctgtaataaatatgacggccttgtcggccaacttttatattgatgtttagttagcattcactgtcgtcttgtaatgtgtcccatggccaaaagtatgtcatcatatgttcaaagttccttagttacaagttggtacgcaaggataggtgaggcactgggtaccggtctcgcccccccaagttcggggcatgacaattggaacccgacgagatagtgtaaaacgatcatggaagattttcagatgttcataatgagttctccatgggtttggacttgaggaatacctatatactaatgaaaaacagaaagacaatagaaacagacgttgtgctacgataaaatcacctccaaaggtgcgcttggtcttgatggagagccttgtaagggtccttatgagaaaggaagtattacaatgacacatagaaggatatgttctctcatggttattgaacaagtgttcggaaactagcacaatgaattcactaactaaagaacacaattaacacatgttgtggagatgtaaagagaaaataaacatttgctatacgctgggcatgcttatgctatattaacccccaactgcaatatacaaccatgccacgagcaaccacaatactaggacaaagtgagctacttactacgggatgtcccaagtggacaaagtgagctactatgacggggatgtgaggatctcaatttttagagagactttatgtacacggtggccatttcgattgacatgaactcatgtgataggtgttaagttttgctcttatgttactagacattgaaaaaagttttatgatgatactcgcaagagagtagattaactgttcaaaccatataagccatatacacaattgagtcaaagagtgactcgagaaggatcgtaatactgagatgctttcatggaacttgacaccacataggtaaactttacgacggtgcatgcataggcacaaatgagcagacgttgtccatataaaagattttgtaataaattcatcggatatagtcccttgttgagaatttaggaaagcaagtcggaaatgctaatcctagagtcataactccattcaaggacacaattatagaacttaattctacgagaatataaataagaggatttgtaatagagtggattcacgagtaatgcatctcgttcaaagagttgatacatgcaatattttgttattcaacaccttgttaagaccatgtttatgagaattcttcaataaggatgtacacatgcaatgagtaaaatttttgtgttgttcataatgatgcactagggagtgacttacttggtgactttaggttgatagggcaataacttaatcgatgcccctcaactccacatccctaacacacgtcggtaacataccaatatactacattatctggtggtacagtgagattaataggaataagggcactcccatcttagcgataggttctaccaatccctccacagatcaatacattctcctaacaagtccttgggcaatccactcaaactcaatggtgggatcactaccctttcatgatttcaaattcgcggattatgctatcatgattactcattttgagagtaaggcttggagagaaaactaactccctaacttgagctctactgcacgatctggagtatcaaagaagggtgaaattcctaaatatccgaatagcctccaacttatagatgtggtcgactacacactgataagagggactctactagacacaactccgagacatcctaggacactttaaaaccttaggctctgataccaagtttgtcatgccccaaaatcgaggagcgcgaccggcgctcaaccgagtaaacccgactgagcaagcctgctaggtttcattctacccaatctaattcacgaacaagtaggagatggactccattaatcatacttagtaagtatttcattaccaacttccatttcattgccattagcagcttaaatcataattatcaaaatattaaaagatttataaatctttgccaaacatcaatatttctactttaattctaatacccgacactacccacaacctgtctacggagcctctaaacacaactgaagagtaatgtaatatggaaatgccggtaacaaggcttcagctatacctcaaatacaaagtacatgatgaacagatgaaacaagaccctaaaacgaagtgggtctcaccaagtcagctgaaaggatgatgcgacactagctgcgaccaacactgcctgctatagaaacacatacatccatttaaagacgtagcgcccccgcaaaagggacgttagtgccatcaaatagcacttgtatggataactaaacaccatctagttagaaagaactttcatacgagaataaagaagaaatcataaagacaacaaagtttcaaataagcaccatgtcaacaatataaggaggttcacatgattttcacatagttcttgaaattttagattggagcatacaatactgttgcatcattatccatattaccactgcttccgtgagcgaagtccgatcacatcccgatcggctaagccgtctccccgagatgttaccattatttcattcacactttctagtttcaatcatcaatacattaccaccacgtgtatatatatcatggcatccgatcacggcccgatcggctaagctgtctccccgagacgttaccattttccatcaatcacctcaattcgatccttgtttcacatatatcatttcataggcacttggggccacatctatcacgtcatatatttggcactaggccacatttcacatcattcccaatttcaatgttagatttgtgatttaggatgatatgtgtacacaagggcaaataaaattgtaagcatagatgagacttcacatagaggatacaacatatgcaacttcaatcttaatttagggtctaagcatttcaatacatgattcatatttcataattcacatttcacattgttcccattttcaacatttactttgccacttaagatcataggcgcatacaaaggcaatttaaatcataagcatagagaggttcgtcaagtttggcatattagtcccaaagtaaccttgacatgacatttaggcatttagcacatagatcatgttctccacacatcctcaatttacaaataataacacattaaatacatgaagaagtacctacgacatacactttcacaataataatccacttaacataacaagtactgtatcaatcacgtttcgaacttacaacatttacacgagcaccatgaaagctcaatttttaagagacggggttttagccatacataactcaatggagctttccttaaatctctacaatataccaacacctctagcaataacaatctataaggagatagcggaaatcgattaataattaggaagattatccatggtgtaactctcttaggaatttcatcaaccacctaacatgtgaagtagactacaaggtttagaaatgacaattccttcctccttcaaccaattttaacatgaactacccatattagttatttaacatcacatactacaacttagtcccacatgcatggcctatttttgaccccaacaacatatttgaacctttaacctattgcatgaagttttggatgtaggacttacccggatggaggacaatttatggttatcttccatgattcttgaagacttgagaaaaatttggatgattatgaagttaggaccctcctttatcactctatattctctcatagaaaatgaccccaaaatgaaccccaaagcctagatattaaaatggggtcgggttataaaaaaggaaacgtaaccctccgaaaccgggtctgcgatcgcagaatggaccgcaaaacaagaatgtgggccacagaatgtaccgcaaaataggtgcccaaaactaggcaacactagcccaatttgcgacagatcagcgatcacaaagtcaaaaatgcgacagatttgcaatcgcaaattcgacacaggatcacatttttctagcctatggtaatttgatcataactttgtgtaggaatgtccaaataatgaattgtttaaagcgttagaaactagactcaatgacctttcatttgataggttgttcatcaaataaaaccttatacatatttagatatgcttgttcaaagtgtggtctagtgcaaacttagttggaatcttagcctattatgaaattttccaatgtgacttaggcttaggtctttccttgggacccaaattacttaccataagacttgtacacttatttaccaaatacaattgatgcccaccatgttaatagcacataaaatattataattaacctacatggcaccacgaaatcctagattatttagcgaaatttttcggggccttacagtaacccgccatgccaagaaaactacggatctttgtagctgaggatggtctaggccaactctacactacctctactttctttggatcaatctgtataccctcactcgacaccacatggcctaagaatgccacaaagtccaaccaaaactcacatttcaaaaacttagcatataacttcttttctctcaaggtctaaagcactgtcctcaggtgctgatcatgatcttcccgactccaggaatacactagaatatcatcaataaagacaatgacgaacgagtcaaggtacgaccggaacatactgtgcatcaaatgcataaaggctgctggggcattggtcagcccaaatgacataacaaggaactcgtaatgaccataccgagtcctgaaagcaatcttcagaatatctagatctcgcatcttcaactgatggtaacctgagcataagtcaatcttagaaaatactcgtgcaccctgtaactggtcaaacagatcatcaatacgaggcaaaggataacaactcttcactgtaactttgttcaactagcgataatcaatgcacatgcgcatagaaccatccttcttcttcacaaacaagacaggagcaccccaaggtgatacactaggcctaataaaacctttatcaagtaattcctgtaactgacccttcaactccttcaactcaggaggggccatacgatacgcaggaatagaaatgggctgagtgcccggcaacagatcaatgccaaaatcaatatttctatcgggcggcatgtccagaaggtcagctagaaacacataaggaaaatcccctactactgggactgaataaactgtaggggtatcaatactaacatctctcacataagccagatacgcgtcacacccattctcaaccatacactgagccttaaggaatgaaataactctactgggagtgtgataaagtacccctccactcaactctcggaatacctagcatagccagtgtcatggttttggcgtgacaatcaagaatagcataatgtggcgataactagtccatgcccaagataacatcaaaatctaccatgctgagtaataacaaattggttctggtctcaaatccactaagagcaatcaaacacgaccgataaatgcggtccacaacaaaagaatctctcacatgagtagaaagataaacaggggtactcaaagaatcccgagatacacccaaatacagagcaaaataagaagagacataataataggtggagcctggatcgaataaaaccgatgcatctctatgacaaactaggacaatacctgtgatgacagaatcaaaggcgacagcctcagtacgggcagaaaggacataatatctggcatggcctccccttctagggagacctctaactccgtgacctccacctctagctggctgagcaggtggggtagcaactagagatataaccataacttgagaactctacggggcacgctgtggctgagaagtctgtggaggtacacccctcctaagtctggggcaatccctcaccatatggaatatatcaccacctctagctggctgagcggttgtgactggcttgggccaggtctgctggactgaccactgaaagcaccctgcgcaggaggtgcactagatactagaggtgcataataaggctcctaaggcctaggaggagctggaataccactggctgctggaagggcgactcatacaacccctaccatgacgacctgcagttggggcacgggcaccagaataatgacccgactctcgagacctcttggcctccctcttatccctatccctagcatgcataccctcaatcttcctagcaatgctcaccacctgctaataatgaatatccatctccaaatcacgagccatgttagacctgatgctgggaataagccctacaataaaccaacgaaccctctcacgaacagtggaaaccaagactggtgcatgtctagccaagctggtgtaacagacagcatactccgagacagtcatagtaccctagcgcaaatgctcaaactctgcgtgccatgcatccctgtggctctgaggaacatactcccttaggaacatatccgagaactgagtccaagtcagtgaagttgcctcatctagactgtctaactcataggtgcgccaccactcctcgaagctggaaagcagtgaaggaaaccctgctcgatcctgatatacccatggtacagagaatacagtagcactcatctagaaatcccagagcatcatctgatgctaacccactgaatacaggaggatcatacttcttgaacctctcaagcctttgctacttatcctctgaagccactgccctatcctcgggctgacctaggctgtaggcggtacatgaataatcgctgggacctgatcaacatgcactcactgctcagacgtgcagccggcgggagtctgtgctcctcccccgacctgagatgtggttgcagcaaggggaaacaaccctgcctaagccaaagtggtgtacatactcatgaaatgtgcaagagtttcctgaagagctggagtattagtagcaataggcgtatcaggtgcttagactctggctggaactgttggcggtacctcgtgtgggtgctctggcttcaccacgtgcgcgtcctcggtctctacgccagccccagcctctaacagttgtagtagggggcgcgggtgcctgaccatctcgggtagcacctgtcctcaccatctgtgagagaatataagatagaagtttagaattgtgatatcaaaaatcttgcacgacaaggaaatcaaatgaagtggaattttcctaacagttacatagcccctgatagataagtacaaacgtcttcgtaccgatcagcgagactctaataaaccggcttgtgattcatgactcctatgaacctagagctctaataccaacttgtcacgaccccagttcgccctttgtgaactgtcatgacgacacctagtctctacgactaggtaagcctaacaaatgcagaaaataacaatttgcggaagaaataattaaaaaccaaaataatcaaatgaaatagtatttaagatgccgctcggcatatacaataaaactctcgaaactaacaacatttcccaaaacctggaatctcatgaaaccacaagcctttgaatgtctacaagtttctaactccagaatgtctaacaaaagtaagcacaaaagggctaatacttaaagagagaatagaaaaggactcttcggtctacggacacgacagatatacctcgaagtctctagaaaagtcaccttgcctcaaaggtgataagactgagtcgaagtacctggatctatacatgaaaacatgcgcagaaagggcatgagcacaccatatcggtacttagtaagtgccaagcctaacctcggtcgggtagtgacgaggaaagttggggtcctactaagattaaatgaaatataaggtaaaacagtataaaatgagacaatataactaaatgcaacagtaagaaataacacagaatagaaggaacaacattaactataatagagataaacagtcacagaaaaagagtacaagtcaactcaaagataacaactggggatcttccaggataccatcctgtagtcctaaatatacatatccaatagatctcccgagataccatctcatagtccaactcatagtgcgcggggatctaccggaattccgatccgtagtccaaaatataaatacctagtactaggggaaactaccgtgtgcagtcccatagttccatataactgtgtagggggatctaccagaatcccacatccgtagtcccaaataaacagacaagggggttctaccagaatcccacatccgtagtcccaaatgtaaatacacagcatcaacatgaaaaatattcatcaaatgtcaatttcatataaaggcaaataggtaattctagcttagcatgctacacagaattcaagtgaagcagtttgagcaaataaagcaattaaatcacttagatatgcttccctaagctaacgacatgctgaaattgcaagtagtaataacaaggtgagaaacacaattttagttacttattgaaaaccgaattttcaacaattagcataagtatgcactcgtcacctcacgttcaaggcatttcaaatatcaacaatatcaaatcctaagggaagtccccccacaaggttaggcaagccacttacctcgaaccgactcaaagtcaacccgaaaccacgttcttgccacgagtactcgactccaaatggaccaaatctattcaatttaattgtataatgtaaataacacttcaaataactgattctacaaagaaattctaagctaatatgcaaaattaggtaaaatgaccaaaatgcccctcaggcccacatctcagaattgggtaaaatttacattttcataatccttatactctcaagaattcatgcataccaaagttatccaaatccaatgccaaattttcaatcaaaactcgaaatctaggtctaagaactttcttccaattttccccaattttcatctccaattcgaaattaaatgacaaaactaagattagattataagaatacaactagaaaggtattaggaatcgttacccactgatttcctcttcaaaatcctcccaaaatctccctctcctgagctccaaatcgattttccaacttttgaaactaaaccctcgaatttctgatttttctgcctagcaaacccgctcttgcggtccaccaatcgcatctgcgataccacttctgcggttctcacttaaaattccatctatttactcgtggacacttttgcggcttgactccacatctgcgggagtcgcatctgtggcctctcaaccgtagatgcggttatgacagcaacccaaagaacttcagctgcaaattccaaatttccaacttcccgttaaccacccaaaatcattctaaggccctcggaacctcaaccaaaagtataaacacgtcatataccactatccaaacttatacaaatctccaaaacacctcaaacaacatcgaatcaaccaattagcctcagattcaagtctaagaacttcaaaaactctcaaaatacgcttttgatcaaaacatctatcaaacctcgtccgagtgacctgaaactttgcacacacatcacattcaacaccacagagctactccaacttccgaaattccattctgaccctcggatcaaaatcttaatatataaccggaaacatcaaaaattcaactttcggcatttcaaacataaattagctacggacctccaaaatacaatccgaacatgctcctaaactcaaaatcacccaacaatgctaatagaaccaacaaaattccattccgatgtcgtcttcacaccattccgactacggtctaaattctaaaacttaccctctcatttagggactaagtgtcccaaaactctccgaaactccaaaaattcctcccgaaaactcacaatagtagaaacaaacacggggaatgtagtaaataggggatcagggcgtaaattcttaaaacgtctggccaggtcgttacagatcaagcttcaagcacaagagaaattgaaaaaatgatggaaagggtaaggagaccggagaaggatcttccaagtaaagaacaagccaaattccagaaaggaaaatggctctacaaaaagaaagacaagagtaagatgaaatgctacaattgccaagttccagggcattttgcttgtgagtgcactttgccgaaaaatgtagcatttcaaaacgcatctcttagtgttattatatatatctctagcactgttttattaactgaatcttatcttatattcaggggacactgaccatgtgagccatgatagagaagcatttataaagtttcgtcaagttccacctggatcaaagcatgtatatgtggaaaataatgcaaagcttgaagttaaaggaataagcacttgcagaatggacatacatggtgcccgatctttgatgttgtaagacgtcctatatgttccagatatttgactaaacttagtatctgtgtctattcttctagatttagatttcaattttaacttcagtcgcaatggtcttagaattactctagaaaatgttctttatggttttggacatcgttatgatggttttattgtattagattgtaactattatgttcactgttgtgttatggcatgttattctagtaataatggtgtttatgttattatatggcatgcaagattaggtctgtagtgacccaaccggtcgtttttctttctagaaccccattcctctaaataagacttcccgtacttaattttactgatttatgacttgcagggatggttggttcgggatttggaaaagtttgggttgaaatcaaaacacttggttcttttaggttggcttaaaaggcaaagtttgacttcggtcaatattttgagtaaaaaccttgaaatcaggatttgacggttccaataggttcatatgatgattttggacttgggcgtatgttcggatcggattttggatgacccgagagcgttttggcgcataatagtgaaagttggttcttgaaggatttttaagttctttaaatttggtttggagcgaggttttgtgatattaaggtccaaatagaattctgagactgggaatagttccgtaatgtcatttaagatttgaacgcaaaatttgatgtcattccgagtagtataagtatgtttcggcgcattggaagtaaattgaagaacttgatgttcttaagtttgatttaattggttttagggtgtgattcttagttttaatgttgttttgggcgttccgagagttcgatcgattccattttatgattccaaacttgttggtatgttcgggcagggcctcgggggccccgagtgccaatcagacgaggctcgaaccaagttgagaatttggaaccacagctgagtgaaccaaatctgtcataatctcacttgcggttggtcagccgcatatgcgagctcgtaggtaaaggccaagcatcgtagaagcggccaaggaagggcacccaggtttcgcagatgcggtccctcctccgcagaagtgggactgcagaagtggttacccgacagcagatgtgacacagccgacccagggcaattccgtagaagcggacccttgtccgtagaagtgggaccgcagatgcagaaatcgctagggcatttattacggaacttagacatttttaactcatttcattccattgttgggcgattcttggagctcttagagaggggatttcacccaacaccttgaggtaagtgattcctacataatatagttaatacatagtttatgggtagattataacaagtgaattggtagaaatcatgggtttaggtgaaaacctagggttttgataaaaaggagattttaccacgaaaatgattatggaacttagtgaaaacatatatttatgttcctaaggttatgagtcacaactttcttcaaaaatttccgaaatccaggcacgtcggccggtgatgaattttaggaatcttgcatttagagttgggaaattacttcaatagtttgcagatgaacttttaagcttatattgattaatttttatactatttgtatagttttggatcattcagcaccaaattgagggtttgggcataagcttggaccgaaaagtaggccttgagacgaggtacgtcacttttctaaccttgtaagagggaaatttccctataggtgaacttaattaatatgtgattaattatgggggctacgtacgcacgaagtgacgagaatccgtatgtagctactattcctgattatgtctgcgaagttttaggatcacgccatgcttggggattcgttatttgattatatttgttattatgatagatgaaaccaagttgaggattttcaaggattttaaaagcttcacgttgaaatgtctatatttataaaagaatcaagaaaagtgttacaatttatttataaattgatatttgaccgtgtcgtatgtatgatccgcaagcgaggtaattccttgaatttatatttgactagtcgcatgtatgatctgtgagttgggtaatagatgcatctatggttcgcacggttcaaccctcagcagtgcacaatttacatttatgttggatcggacggaacgtcctcgatggtattcgtgtgtgataatagaactggatttttttataacttttatgaattgtcgtcgagagatcacttgttttaaatgaaggtagtactttggtttcctaaatatgatggaaggattgttcagttatttatatttcttgttatgagattattgttatctctatatattatgcttaaattagaaatttcatattattatattgttggccctagtaagtgttggagtcgacccctcgtcactacttcttcgaggttagactagatacttactaggtacatatttttatgtactaacgctacacttctgtacttaattttacaagatttaagggaggtgcatctggtcacctgtcaagcgcgtagattttatccccctttcgagacttcacggcgagctatcttttgagccgcactgcagcagctggagtcttctttatgctttgtttttttgtctattttcttccagacagtaggctagtattcttttttacattctactagattgcccacatacttgtgacaccaggtcttggcacatgcactagtagacttatgattttggtattgtatacatgattaaggtttatatttgtttcttccttttaacttggcttcattggaaaatttctaaatcttttaacaaatgaagaattttatccgcttagaaatttgtttaaatgggaaattaatagtttgatcaatgttggcttgcctggcaatggtgttgggcgccatcatggcctttgatagaattgggtcgtgataacatggtatcagagcactaggttcacataggtctcataagttatgggcatgcctagtggagtcttacggatcggtgcggacacatccgtacttattttgagaggctatagagtgttaggaaactactatttattcatctcttatcgtgcagttgatggtaaactaagtttccttgttctattctctcatagatggtgaggatgcgtacaacggatgttccagacctgggagaagctattccctccgttgttagaggccgagacagaggttgggggagggaaccaacccgaggtaggggacgaggatgtcctagagctaccccaatagaaccaccaatgaatccagtagaggatcccatcatgaaggagcagggtaaagtgcctgacgcagagccagccttggtagatttcatgacaacactgggcttttaggaggtcatgggccatatgctacggttcatggacattatgactcaagtggtttatttccaatagatccatccatatctcaggcatgagggagagcacagacccctactgctaaggctcttgggcacacaactacagtatatcagactacgggtacactacccgtgggcagggcccagccaattaccgcagctgcacctgagcctagaccagctgcagacaacaatttgcagaagctattggatagatggactaggctacaccttcctatcttcgaggtcgagcgagattaggatccccaggacttcattgaattagtacagggacatactacacaacatgaggatattggagtcccatggagtaggttttactactttccagctggagggcatggaccgtagatggtggttgtcttaccttcttggcagaccagtgggttctcctcccatggcttgggaccagtttacatggcttctatttgacatgtatattccaccatctcagagggaagagttgcggtgttattttgagcagctagagtagggtcagatatctgtgaccgattatgcggcgagattttctgagttatcttgccatgcacttatgatacttcctacagacacagagagagtgcaaagatttgttgcagggttgcacctcggtattcaggctagcatggcatgagaggttgagatgggtatatcagctaatggtggagattgcttggaggattgagggctatcactagaggggtagagagcagatgcagcaggacaagaggcctgattctctgtagagtttagaggtgctccagctagggcaaacgtcagtttgggaggggtcagcctagtaggtccacatatccagtaccaccacctccttggggtgatcgagcgcgaccctattttagtgttatgtcagagagttcttatcacccaccagcttatcacggtccttctagtgcctattacagtgtcatgccagagagttcataccgcccaccagccattcaggccatcagggtcatactatgaggtagcagtctatggtaacgaggttgttacgagtgtgaagatctgggtcacatgaagaggaccttccctagacttcggggcaaaggaagtacaacagggtcatcagcccatgattgcaacaccagctgcctgaccgcctagaggtgggggataggctggtaggggccgtcttagaggtggaggccagacagggggaggtcagccatctaatgttcaataaggtggacaccggccagccgttgctccaactagattctatgcttttttggccagaccagatgcaatggccttagatgccatgatcataggtattatttctatatgcggtagagatgcttcggtattatttgatctaaggtctacctattcatatgtgtcatctccgtttgctcattttctggatattcttcgtgagtccttgggtactcctatttatgtgtccactcctatgggcaattctatggttgtggattagatctatcggtcctgtttggtcacattctgtagttacaagactagagcagaccttctgttacttgaattttaaggtcatcctgggcatggactggttatccccatatcacgccatccttgattgtcatgccaagattgttactttagcgatgctagagttgccgagagtagagtggaagggttcctttgttagtacaactagtcaggttatcttttttttgaaggctcgacatatggtcgagaagggttgtttggcttatctagcctatgttcaagataccatcgtagagtctccaacgattgattcggtgatagtagtccgggagttcgccgatgtgtttccttctgaccatccaggcatactgttagatcacgatattgatttttgtattgatttggctccaggtagccatcctatatctatcccaccgtaccatatggctccgaaagaactgaaggagttgaaggaacaaatggaagagttgttagcaaaaggggttgtgagaccaagtgtatcaccttggggtgcaccaatattatttgtgaagaagaaagatggaactatgcggatgtgcattgattaccgttagttgaacaaagttaccatcaagaataagtacctgttactacatatcgataatttgtttgaccaaatgtagcgtgctagcatgttctctaagatcgacttgaggtcatggtaccatcagctgaatatttgggactcaaatgttctgaagactgccttctgtactagaaatggccattatgagtttctagtgatgttcttcggcttgactaatgctccagcgacatttacggatttgatgaaccaggtgttcttgccttatattgattcctttgttattgtcttctttgccgacatcttgatttactcacgtaacctggaggagcacgagcaacatttgagagtgctgcttcagacattgcgagaacagaagctatatgctaagttctccaagtgtgagttttggctagagtctatggcattcttgggcatgttgtgtcattaagatggatcccaagaagaaggcagttcagagttggcctcgtcccactttggtgacaaagattaggagtttcctggggttagcaagttattattgccggttcgtacatgctttttcatccattgcagcacctttgactagattgacccagaaaggtgctccattccgttggtacgatgattgtaaggtgagctttcagaaactcaagacagctttgactacaacatcgggtttagtgttgccttccggttcggggatgtatacgatgtattatgatacttcatgtgttggcttgggttgtgtattgatgcaggagggacgagttattacatatgcttcgcgtcagctgaagactcatgagaagaattagcctgtgcatgatttagagtttgccacgattgttcatgctcttaatatatggatgcattatccgtacgggatgtcatgtgaggtttatactgatcatcgcagcttacaacattttttcaagcaaagggatctcaatttgaggcagcgtagatggcttgagttactaaaggattatgacatcatcattctttatcatctgggcagggtaaatgtggtcgtggatgccttaagaaggaaggcagagagtatgtgtagcttggcattcattatagcagaggagaggccactagctttggacattcggtccttggctaatagacttgtgaagttagacatttcagatcccacccgagttcttgcatgtgtcattttccagtcttcactattggggtggatcaaggctaggcagttagataatctgcacttggtagttctcagagagacgatactacaggttagttccaaggagggctctattggcgaggatggtgttttgcgactccagggtcatctatgtgttcctaatgtcgatggcttgagaggaaagattctagaggaggcccacaattcttggtattccattcatttaggtgctatgaagatgtatcgtgacctgagacaacaatattagtggcgatagatgaagaaagacatagttgagtatgtagctaggtgcctaaattgccagcaggttaagtacgagcactagaggccagatgtcttgctccaacagatgactatacctcagtggaaataggagcgcatcactatggactttgtagttgggttgcggcggatcttatggaaatttgatgcagtttggctcattgtcaataggttgaccaagtcggcagtcttcattccggttgtgactacatatacttcggagaagctagcccagatttatattcgagagataattcggtcgcacagtgtgcctatttccatcatattatatagaggccctcagttcactttgcatttttggagagccatacagagtgagttggggacccgtatagagctcaacactgtgtgttgataacaagggattctagtctattttatactctttttgcttgagttttggattaaaaaggtatacaagtaaccctgaaagcttacatgttgtgtttgtttgcagtgtttggtcaaaaagtgacaaggaagtcaaaaccagctcaaaaaggagtgaaacctgcacaagtgccaaaaacaagtcaaagcaccatgacaacagtaaatccaccacggctgcaataaacccactacgaccacagtacatttgttatggtcagcgatggcaaagatcagagaggatgcaattttggaagttaaagcaatgcagtccacggttgattcttcgcggccgcggtagccttatcgctgccacattctattttttgtggtccgcggagaagggattcggagaatgtgaagtttggaagattcaagacaccgcggttcgcggtccatttgttgcggtccgcagtgaagccaccgcaaccacaatccatttactgcggtctgtggtggccatattcagagatttagacgtgaagcaaaaaagcctcaccgcggccttggtacctccttcaagggcttttttgtccagaaaatttggccttgtataaatacttctttttcagatttttaggctatctttatcttagcagagcatgtgaacggcgatttttagctattttgagcaattgtgtagctagtttaacattgaatcttcaaatcttagcttgtaattatattttatgggttatttttcatctaaatatttgatttcttccattattatgagtagctagacccattagctagggttgtagctcaaccctagtgtgggtatttgatgggtcttttcttttaaggcttaaatgtttatgggtgattgatatttggcctgatttgtgttctccatgttgaattagtggttacaaacactaatctgtgcctttttgacttgggctcttcttgagaaagagagtttgagtctaggaaaatcaggtcaacaaggaattggggcgtattcaagagaatgatagccctaattaaagggttaaacctagagatagtaatacccgacttgagcctatattgcttgcacaattttgagacccaattggtcttgagaaagtcaattagggcaaagtcactcaagctaccgagaggtatagagcgagtagtgtcgtgcattggctatatcacgatcccaaacataacaactttgccttagactttagaacccgtcaagtattcacctaggggaaagtcacttccctaatgtctctttaaccatttagaaaaccttacaagtattcatacttagcttaattttgcatatcattagcataaaattagaagtaacaaacaaacaaatatgattggaagtgtaatcaagagcactacacactgctagattagatagaaatccaactccaaacattattgtagctcccagtggattcgatcccgaccttctcaggtaaaagctgcttcgaccgctatcgccactctgtagtggtgtagggttggacccggtcactttctggtgccgttgctggggagttaagcggttttggctatctatctgaattgttttgtgtattatttttctttccttccgtgatactaatttgtgtgtgtcgccaattcaggtacaaaaatggcggcaaacaccaataatgaccctcttggaaacgtgatcccgggggaggaggttgatgataatgttgaagatgaggtacctcttatacctcaaggaaaaaggagaggccgccatgctaataataatgttccagaccctccccctgccacctccaagagtggctctgcaggtgcttccaaaccaaggatatgctagtgcaattgtcccaccccagatccgggtgggcaatttccaaattacacatgtgatgctgactttgttggagcagtgagggtatttcataggtgctccccatcagaatgcctacaaacatatttagggattcgtggatacctattgggggagcaagcaaacaaatgtgtcagaggatgaactttggttgagattattccctttttcatttagagggaaggctttggactaacttgaaatgcttaccaaccattacatcactacttgggatgagttggcggataaattcattgcaaagtgtttctcgtcgggccatatggcgaccttgagggatgaaatcttagctttcaaacaggagcccaatgaaccactgcatgagatatgggagagataccagaccatggtaaaggagtgtccaaataatgatatgattgaggcaatgatataacagacattctaccgaggcattaacacaacaaatcagtgcatagtgaacgaactcatcggaggcaatttcatgaacacaccatatgatgaggctaatgcaatattggatgagatggttgacacgtcctccgcttggcaaagtagagccaatgtgccacagggtgaccccacaatcattcacttgcacaaagagctctatgatcatgtacaggcaatagcagaattgacaacaataatgaaccaactagaaaaggcacaattacaataggttcaaactccacgacaagtaaatgctatgaagggtgtcaacatgttaatgaacaaaagaagacaaacatgtcaacagaaccaagggagtttggatcaatatgaccaagatagtggtgggttccaagatgatgggtatgatgagcagaatgaagaagtgcaatacgtgaacaactatcagggccaaaggggcaattcttcagaccaacaacaatggagaccccaaggcaattggggaaatcaacaacaataagggaatagtaattgggggaataacaaccaaacttcaaattgggtcaaccagaacaacaatcagaacaatcatggtaatcggagtggcaacaacaacaactgacgtggaaacaacaatcatggtggttggaacaataacaatcaagggaactgggggcaaggctttcaaaggcccccgatgtatcaacaaccaaacaattcacccccatttccatcccaaggtcctagttcttccaacaatgaaatggggagaatcgaaataatgtttgaacaaatgatgaaaaagaatgctgactctgatgcccagttggcatccctcaatacttcaatcagaaacttggaggttcaattaggccaaatctcagaatccttgaatactctccctaagggggctttacctagtgatacggtagtcaacccaaagggtgggaacaatgccgaacatgtaatggtggtaactacaagaagtggatgaggcggtgatgtgaatacctccaaacaaaaagaaattttgagtgatgaatttgagttgcaagaggatgatatccctttggtggttgagaatgtgactgatgtgaacgtggatgaggaagtgaggattgatatccaagatactgagatggaaactcagcatgacatggacccatctgtggaacacgtaacagatatgccagaaatgattgtgcctaaagccaaggttcctttgccaaggccacctccaccttatcctcaaaggcttacgaagtagaaaaatgagaactagtttaagaagtttattgacatgatgaagagcttatcaattaatgtgcctttggtggatgctctataacaaatattggggtacgccaagttcatgaaagacttggtgacaaagaaaatatcaatggattgtgagactatcaagatgacccaccaagttagtacaatagtgtactcgatggatccgaagctagaagatcccgttgctttcaccatttcttgtaccattgagagtgaaaactttgcaaaagctctatgtgatttgggagaaagtatcaacttgatgccttactctattttcaagactttgagtattgggcaacggagggctacttcaatgaggttgcaaatggcagatagaactatgaagaaaccgctaggtattgtcgatgatgttcttgttcgggtggacaagttcattttgcccgctgattttgtgattttggattgtgaggtagattatgaagttctgatcatattgggaagacctttcctcgcaactatgaaggccttagttgatgtggaagcaggggaactcaccttccgggtgggtgatgaaaaagtggtctttcatgtgtgcaagtcaataaagcagtctaatagttttgacgtgtgctctttcgtagatcttgtcatggcagtgatagttgatgatactagtgcaacgatcaatgtggaggaccctcaagaggcggtattgttgaatcttgtgtaaatgaggatgaaggccaggtggagtgtgtcaatgctttacatggaatgggctcttactcttatgagccttagaaactctctttggattttgagaataggaaaactccaccaacaaagccctcaattgaggaacacaaggagttgaaaccgcctccacacctcaggtatgaattcttaggccctagttcaactttaccaattattctttccttttgtcttactaacatgcaggtagatgccactttggcggtgctccaaaaatggaagaaggcaattggatggactttagctgatatccggggaataagccctgccttttgtatgcacaagattattcttgaagatgatgcaaagccctccgtggaacatcaaaggaggttgaacgaagcaatgcaagaagttgtgaaaaaggaggtgatctagtggttggatgcaggggttgcgtaccccatctctgatagttcttggacttcatcggtgcaatgtgtgctgaagaagggtggtatgaccatggttaccaatgtgcaaaatgagttgattcctatcaggactattaccgaatgaagggtgtgcatgggctaccgcaagttgaataaagtgacctgcaaggatcactttccattgccttttcttgaccagatgttagatagacttgctgggcgtgccttctactatttgttggatgggtattctgggtacaaccaaatttttattgctccggaagatcaggataaaaccaccttcacttgtccgtatggtacctttaccttttctaggatgccatttgggttgtgtattgcaccggcttcattccagcggtgtatgatagacatatttaccgacatggtggaggaaattttggaggtgttcatggacgacttcagtattgtgggtgactcgtttgatgaatgtttgaaatatcttgatagggtgttggcccattgtgaagaaaccaatctcgtgcttaattgggagaaatgccactttatggtcgaggagggcattttcctcggccataagatctcaaagcaagggatagaggtggacaaagccaaaattgaagtgatttcaaagcttcttcctcctacctcagtcaagggggtgagaacttttcttgggcatgcggggttctaccggagatttatcaaggacttttcaaaggtagtgaatctcttgtgcaatttattggaaaaagatgccaagttcgtgttcaatgaggaatgcatgatagcttttgaactcctcaagtacaagttgacctccactcctattattaccgcacccaattggagcttgccttttgagctcatgtgtgacgcgagtgatgttgaggttgtggcggtcttgggtcaaagagtgaataaaatttttcacccaatgtattatgtaagcaaaacaatgaattatgctcaagtgaattacacgatgaaagaaaaagagttgttggctattgtgtttgcaatggagaaatttagaccttattttatgggggctaaagtgatagttcataccaaccatgccgcactctgatacttgatgacgaagaaggatgccaaaactcatttgattagatgggtcttgttgcttcaagagtttgatttggagattgtggaccgaaaagggtgtgaaaaccaagtggcggaccacttgtcccgcttggaagaagaggggaggccccgtgatggccttgaaattaatgattcttttcctgatgagcagctcctctccgtatcagtgaatagcatgccatggtttgcggatgttgccagcttcctcgtgactagtattgtcctgtatgagctctcttctaaccaaaggaagaagcttaaacatgatagtttggactactattggcatgagacttacttgttcaagatatgcactgacggtgtgatccgaagatgtgtcccggaggaggagcaattgagtattctagaggcttgtcattcctctccctatggtggtcatcatggtggggtgaggacaacttcaaaggttcttagttgtggtttttactggccaacattgtataaggatgcaagtgaacttgtgaaaagctgcgacgaatgtcaaagagtgggttgaattttaaagaaggatgagatgcctctcactacgattctcgaagttgatatctttgatgtgtggggcattgttttcatgggcccggttattagttcatatggcaacacatacattctagtggcagctgactatgtttcaaagtgggctgagaccgtggctttacccaataatgaggcccgaagtgttgttgcatttatcaagaaaagtatttttactaggtttggtactcctcgagcaatcataagtgtttgcttgcaaagtacggtgtcaatcacaaagtttctaccccttataatcctcaggcgagtggccaagttgaagttttaaacagggaaatcaagagtattttgtcaaagatggtcaatgcaaataggaccgattggtcaaagaaattggatgatgctctatgggcttataggaatgcttacaagactccgattggtatgtctctgcaccagttggtgtttgggaaagcttgacatctaccgatcgagttagagtacaagtccatgtgggctttgaggaagctggatcttgaatgagatatagcagcaaatctttgtgtggagcagcttaatgaacttgatgaattctgatttcatgcctactccagttcgtccttgtataagtacaacatgaagtaccttcatgacaagtattctcgtggcaaagagttcaaagtgggtgatttggttctcttgttcaattctcggttacgtctgttttcgggaaagcttaagtcgaaatggagtggacctttcgaagtggtgcttgtgactccatttggtgcacttgacttgaaaaacaagaatggagagatcttcagagttaatgggcacatagtcaagcactatcttggcaagattgatgacagccacgtggtggcaatgatccatctaaagtgatttgatggtaacctgcatcgtgccgcgacgttaaatcaagcgcttcttgggaggcaacccatgtgtctttctttttctttttctttgattttattcttagtgtaggatttgtttttggactaactagttgtgagatatgtgtagggctattttgatgcactacaggaccaaattagaaaaacaatgttgcactctctgaagtttggatcgctgccgcattgcatttttcacggacgcaatggccttatcgcgggggaaaaatttgattgcggtccgcagtgctatatggtaaaaagtggaggttctctgaagttttcaccgcggttgcaatgcatttttcgtggtccgcggtgccctaccgtggatgccgagcattttctatgtctgcggtgaagttcttgtcagtgtcttctatttttaattagcatggtccgcggtggatttttcgcggtctgcggtgggtaagtaatgtgggtcctaggactttttctataaataggacctcgggcccccttttacacttttcgctcatttgcactctaaataggataaaacactgttcatcacaaccctaagttgcacaaattcaaacactgaatctcaatcatctgtattgcatctcatctctcgtaattcaaatctttccctagtttttaattttgtttttttattattctcttttagtttgttagttcgtacttcttcttctttctttttctttcaatctttaacctagggttatataatgttgtttagattaggttttaattagtcaaaatggtcattaactacctagtgggttgataatgtgttgtttaaggctaaaatgcacaagtatttgaaaccctaggtcttgttgcttcgttttgcctaccgcgaccgcggttgatatttcgtggtctgcggtgcctcactgtggccatgatgcaattttttgcggtctgtagtgaccttattcagagagtgggtagactaattcccacccccactgtggtctgcggtgctattttatgcgatccgcggtggtgcctttgcggccgcaatgctttttatgaggcgcggtgaattgtttccattcatattcttcactatttcttttggtactgtgatagtaacaaatattaactgaattctccttggagacaatggttaagtcatgaggcggtggtgaaaaacataaaggaaaaggaaagtcctcccggggtaggggacgaggaatgattagattgacccacaggttcgaaaagcaattggggaaacaagaaaacaaatcaaagctgcagatagagctgcttcccattcatagggaagtgagtatttgccctcctgggaggcatctaagtctgattcagtgctggagtatgtacctgatatcccggggaggtttaggttgagagatatgcccacacctctggcctttcctactgctcaagcttcagttcaagtttcttctaagtcgtttgagggctcagcagagagcagtgatagtgaaacatctacttcacccacagctttaacaccctaggaggatcccattgatgaagaagaagggggataaccccaaatagggggtgtggaaaggactagaaactggaggattggcaaaggagatttgctagtgagattgcttgccacaagttgggaaaattgactcttgagcggaaattcattgagagagaccttttgcctcacaaccctaatgtgaagaggcaattcagagagagaccaagctgggaatattttacaagcaaagtctgggatgcaaactagcacttagttaaggagttctacgctaatgttgcccatatcaaaaagggcactaaagtgactaaggtgcggaatttgatagtgaagtttgatgggaagacaattaatgactatctaggctttccggaggaagatgaatcattatacttggaaaaggtagcattagatgaggcagcccctccgtggttagcagaatacctagaactcccgggtaccaccccagcatggttgacatcaggagttcaaatttttgaggaaggccttaaatttcgaggcaaaagggtgggagacctttgtatgtagcaggctggaccccactacccatgagaactcttttccagtctctcgggcgatattggtggcttctattatggcggggttcccgatcaatattaggaatgttatgtctagggtgatcacaagggtggtcaatgaaggtgatagatcataccccttcccaaatttccttacaatgtattttgaggaccaagatgtggagaaaaggaagtttgatgtgaaggtgaaaccaaagatgcccttttcatggtacaacctcaaggctgatgaaaaccccaagccaaagatcctaaaggtaagccactacttctactggccagtctgaagagccagtagtagtagtcatttcttcttagccgcccataggcacaccagatattacccctggaccatctacttccactgctccacttatcctccccatcctcagcctacccattgacttcccactatttgagacaaacactttctaatatcaacaactggatgcagacaactacttctaagctgtctgtgctttctagcttggtggcaggccagtccgtacccccacagccacatgttccagcttcagtggaagagattctcaagaagcttctggacaaccagaagaagctcctggagaaccatcagttaattctggattctataggtgctcatggaaagtcactaaaggagatgaccaataagacaaagaagctgagaaagactcgagcctcaaaggagtcggtgaaggagttgagggtagaagtggagaagatgaaggctaatgaccatctatcattggagctactgttgcatgaccatcctccagcaactcaaactgagccagagcaggagttggagagggcaccaaagaggaggagagtgatcccccagccagatgatgtagtgattgagttggaggacctgcagggaggttcctctagccagcttcaggtttcaaagcaaccttaggacccagatcaggtacaggttacatggatccagtcgcaggttcccgagcagtcacaggacccagggacccaggctcatgaccccatgaatacggaggaccaatagggaattttctttactctctatccttttcttgagtttttttgctagttagcattgaggacaatgctagctttcatttgagggggtaaccctattttgatgattttggactgtaattatgatactattttcctttttgttatgctttttcactttttgtatgtacataattttaccagtttatttcacttttcgtattttgcaaccttagtttgtatataaagttactttctgatgtatatattcattccctcttatgtatattagtttaaattccctattgtacatatttagtttaccttctgcattttatttcatagcttcttacttcatcttagtagcttccttttcagttcatagcttcttattttgagttttgcgttcaataagcctttgtttttttaatgccactgttctttccaaaggtggaatttgtgtgaaccaggtggctcttcccgatgatggatggaataacaaccttcttaagggtttgagtctgttttctttttatttttgtgtaaataatagctcgtgagtaatagtgtctcaagcaaagcttcacttaggcctaacaaaattgcctttcatcttatggtcaaaaacaaattggtatgtctaggatggtgacatttgggaccttgagatttttgtgttagctaataatcatcaagtggttttcgggaccatttgcgttgctcaaatcttagctaaggtttttgtgggctcccgactctgtctctttagcaatcctatagcttgtgtggtgagaatttgatttgcaagtccatgtcccgtaccattaagtctagaacttgccctgaatgtttgtctaggcgaaatcctaaatgtagtttgacttgagaagtgattataggctctccttgatccgaatggtatcttgaaaacatccatagcctaccaatgataatatccctagtcaacctctttgagccatgccgtttttctttccaagaccataatacaagcctttacccgttctaaaaagaccttttcttggcatcgatctttcctttgcacaaggaaaaatcataagttcagggggagagataaggaatgcaaaaagtggtaaaaggtacaaaatgaagaaaaggaaaggcaaaaagaaaaagaaagaaaatcaaaaagtcaaaaagaatgaacaatgtagaagaaatgaagggattcaataaaagtaaaaagataaaaggtgtggaaagattagaaaggagaaaaaagtttgaaatgaagaagaaatagtgatggtgtgtatctctaacccctaagaaagaagcaaatgactcaaagagtcaagagaatgtgtgccaaaatgaaacaaatgaagtgcttaagggaagatgaaacctacttagaccaaatatttcctaccctgaactaaaaaccttcattgtatccccacaaaagccctatatgattttgagttgagcgaatcttacattagttgtgactcatatatggggcaagcttatggtacttagagccggacttgtgacctttctttgagagagatgagtgtgtcatccacaatcctcattttgagtgctataatctaaaagtgaggttttgcttaaggaagagtgaggagtatgagtttgggttccataatgaccaaagtagtagaaagagtttccttgatgagttgagtcaactcttgatgcttttgtgtcgcactaaaaccatggtgcttaaaaggttgaatgctgttaatgattcatttgaattgagggcaattgttagtcctaattgatgctagatgaggttactttaggtcagctgaattttcttggttttattcttagggaggtgggacttactttgtttgcttgaagacaagcaagagcttgagtttgggggagttgataactagggattctagtctattttatactcatttttgcttgagtttcagattaaaaatgtatacaagtaatcccgaaagcttacatgttgtgcttgtttggtcaaaaagtgaaaaggaatttaaaaccagctcaaaaaggagtgaaacccgcacaagtgccaagaacaagtcaaagcaccgcgacaatagtaaatccaccggagctgcaataaacccaccgcgaccgcattgcatttggtgcggtccgcagtggcaaagattagagagggtgcaattttagaagttcaagcaatgcggtctgcagttgattcttcgcagctgcagtagcctcatcgcggccgcattccatttgttgcggtccgtggagaagggattcagagaatgtgaagtttagaagattcaagacaccgcggtcagcaatccatttgttgcggtccgcggtgaagccaccgcggccgcgatccatttactgcggtccgcggtggccagattcagagacttagacgtgaagccaaaaagcctcaccgtggccgcgttccctctttcaggggcatttttgtccaaaaaattcggccttgtttaaatacttctttttcatatttttagggtatctttatcttagcagagcacgtgaacgacgacttttagctattttgagcaattgtgtagctagtttaacatttaatattcaaatcatagcttgtaattatatttgatgggttattcttcctctaaatatctgatttcttccattattatgagtagctagacccattagctagggttgtggctcaaccctagtgtgggtatttgatgggtattttcttttaaggcttaaatgtttatgagtgattgatatttggcctgatttgtgttctccatgttgaattagtggttgcaaacactaatttgtgcctttttgacttgggctcttcttgagaaagagagtttgagtctaggaaaatcaggtcaacaaggaattggggcgtattcaagagattgatagccctaattaaagggttaaacctagagatagtaatactcgacttgagcctatattgcttgcacatttttgacacccaattggtcttgagaaagtcaattagggcaaagtcactaaagctaccgagaggtatagagtgagtagtgtcgtgcattgtctatatcgcgatcccaaacataacaactttgccttaggctttagaacccgtcaagtattcacctaggggaaatcactttcctaatgcctctttaaccatttagaaaaccttacaagcattcatacttagcttaattttgcatatcattagcataaaattagaagtagcaaacaaacaaatatgattggaagtgtaatcaagagcactacacactgctagattagatagaaatccaactccaaacattgttgtagctccctgtgaattcgatcccgaccttctcggataaaagctgcttcgaccgctctctccactctgtagtggtgtaggttggacccgatcatatttcacccatagaccaatgggtagtcagagcgaactgttaagatattagaggacatgctttgagcatgtatgattgactttgggggttagtgggaacaattcttgcctttggccgacttacaacaatagttatcagtccaacattgagatatctccatttgaggctttatatggttggtgttgtcattctcccaatgggtggtttgagcccggtgaggcaaagtgttacgtcctgcagtattacactacgatgatgttacgctttgcagtattaagttactatgatattgcaccatgtagtattgtatgttggatttttcgtaaggtaattgacatcagtccaagtaaaagattatttgaagattataagattatgctatttcacaagtgatgaataaattcgtaaaggtgaaaggggaagcaagccaaagaaaatgaattttttcatctaagttttgcatattggggtaaagtacggcccgagctaaaatatccggtatttatggactagtgacatgcaaggtactacatgcccatgctagaaaggtgtataaggtatgtgaaaagtgagtaatattttaagtaagtgggaatattctcaattatttgggtaattggttaattaccgggtaacatgacattacccaattaactaataagtggataagattaaatcccttcccccacaccctaaacaaaatgttgcaaaaggcccctatttgagaaaatgactcatgttgatttaagagtaggtggctgccaaggatttaatggaaatattaaaacaagcaagacttagtacatgtcttgtttccatgattcatttggacaagagcagaatgtctttgagtcaacatagaaatcatatctccatttccattttgaagaagagtaacacagccattctgcaaaatcaagaaaattttatttcttcgatcaaatactgtaacgtcaaagaacacaggaaatcgttcaaacacttcaacgagcagaagcctaattctgtcaaaattttgtggttctaacggagtacggtgcaatattttccaagaatatcatacagattttccctactccaggtatgttaaggctaagctttccttcattttagcatggtatcataattacacaagttcgataatgaggcatagagaaaaattcatatcccggaatttacgtatattttgctagtctcgcaaattacatatattctcctagttttgtaagttataatattctccttattgggacttcatattcagttgaatatttccttcatccagtcaagagagtagagaatttatatatatgcagcattaaaagtattttcattaccatcgagctataatcgatggacaggcccttattgggcaacctctgatcagatggtaagttatatgctgatcctactgtggccgagcacctatgagtgaacccagttggtcaagatacagagcctagtatggccgagcgcttatgagcgggactactatggcagagcagttatatatataccgagccttatagggccaggcaactattttactcactatattgagagtgttgagttagtatcagcagataagcatatcttcagattttcttgactcctagttgtttttagttattatattatcaattcattttcagctttagtatattgccttacatactcggtacattaattcgtactgacgtccatttctagggccgctacatttcatgcatgcaggttcagacaaatagacgggtagacctcctcagtaggtgttgcccgagtttagctttatcagtaagctccccgtctttcggagttaccttgtctagcagtgtggtatatatcttgtgtatatatgtagataggttatgggtaggtcagggccctattccgatcatagtacatctatcagtaaaggcttgtagatatatcctgtcagttagtacagtatgctgggctcgtaggccctgcacatatcttttgttggcttgtcagttgtagtaattatgacagccttgctggcccagctatatgttgacgtttagtccacgttagtccctttttagctttatattttgcatcacacattatcttgcaatgtggctcatggccaaagtatgatattacatgttcagagtctcttagtcgaaagtggtatgcaaggataagtgaggcactgggtgtcggtctcgcccccaggctcggagcatgacaaaagtggtatcagagcagttatgtcctagggggtctacaagcagtgtctagtagagtcttatttatgggtgtgtcgtgcaccacactcataagcaggaggctacaggttatttaggactgccactctttcttcttactttagatcgtgtggtagagctcagttgtaagaactctatttcctaaactctatcttattcataatacgacgatatttacttttacaaggccggttggtaaaagacatgactatggaagagttgagtcagaggaactcgaatttgcatcatgcttatgatgagtaactataaggtcttcagcagatcatgtgcgtactgaaaggtgtaagccttttaataaggaaccttaagggaagaatatttatccacctttatggtgaaagacaatgctttcaagaagtaaaagaagcaaggtaaagaagggtatgagttgcccaattaatgaagattatcagtattacagttccagtagaaaaatataagcattaagagttaccctcaacagtaacagaggtatgtacaattggctgtacccatctcagttatgccctatgggggctaacaggtgtagtttaataaaaggacggaacatcaggacctggttggggttagagtaaaccaaaatggtgaatgaattgtttgtgttagttaacatttccgaaggatattgaagatctgctaaaagatctctttatgagacacctagatggtacactttaaaatagtgcagccagatatgtgtactacaaagacatgcactataagccttgaagggatacatatatccctagtgtggctcacgtccctagtaaagcgagaatattaagacacttaaagagctactggatggagcaaagggaagctaaaagcaaaagaatgtcttgttcgagttttcagaataaaatgacaggcataaatgttagcgggaacaagaaaaagaaaagagttaatgaagcattatgagtaagatgtggtatatggatgacaacggtagatcaaaagatgacaatattacaaaatctatagtcaagtgaaggaagatacgagtggtgatagaccttaggacaacaaaagagtataggtcatatagtcatgtcctcatttcgagaaataatttcgcaactctagcacgattaccaagggaaaaagttataccctagagtaatagaaatcagtatgggctggtgaataagataaactaaatatgaattagggactgagtgaatttgtaatagtcagcatcatgagaatttcagatcgcattccgacaataataggatggacaacagaaggaggttcatgagaaattcagagaatggtcattcaggaggacgtttccctaaagcaagcaatgttagcaaatttaagcttaagggactgtatgtaccagttacattaagtgtcaccctcatgagtaagggaatttttcatccttggtatagaaggattgccgcaaggcaagtaaggattattgatgttttgaaacgacgccaaacatgaagaggtaaaacatctatagatagatcctcgtggcttcagctcttagtacacccctaaaggggggatatggagtgatgtggcattaatcaaaattaagtggttctagtgactatggaatggtaaaggaagaatgcgataaatgaaaaaggaatgagatgggacttatcccaatcttacatatatgctacgatttaagaatattgtgcaagtacgatgttaaggagagaaagtaaaggttccttcccgagctgttattaataaataaggagccagtacgagacgtaagttaagataaaggaaaaaaaacaagaaagattatgaggaatattgatatgagaatgggccaatgagtagttagtaattggtcaggaagatcccagttatggctaaataggaggttatagacgagtcatcagatcgtgtgagataaacatagtagaaaccaacatagagagttcatcctcgaagaatatcattataatacttgagatatattcaaacaagagtcggggtagttaaagataccttatgagtgttatggggataaaaaaaagtgccactgggaaggcagtcaaaatatcagttcagaagcaactatacaagcacaagggcatggaagtaagcaactatggatgattataggcaagtaaggacatcaaaaaggtctgtaataagctcacaactttacgagagtcaagggttctccctaagtactacagtgaaagactagctgaggagataagaaagaaggcttcaacctaagcacaccgacctaaagaggaaatggtcatgtaacaacaatcttgcaacaacattgtaagcattccaaaggaaagtggtacctaccgtggctaatgaacgggaagtaagaattaaaagtaatattcgagatcatgtgagttgtatgaaaattatggcatatatgggaactaggatgagttaagtatgcaaacaacaaggggcagaaagaccaggaaaagtaattgcacacgtttaaagaaagctgagatggaacaaaaagaattattcgatcaatgaatctgagttagtacgttatggatacactcaagattttggagcattatccaagcaacatattttgttgacaatcatacggctatagaaaactccagtataagttaaaagaaagaattgagcccagggcataggcaaaggattgaattgttcaaagattgtatcatggatattctataacgcccatgaagagctaaggtaataactgataccatgagccacagatcggaagatagcttaagcctacgtaaaggctgatcataaggaaaggaaaataaagaattacatcacccatgtaaatcaggagtctgattattggacctagaaaaattatagaagttgagcttgagaacatgatagaatcactcttaatatcagatgttcaagagaaataacacaacaaccataatctataatggctctacaaggaagccagttagaagaagtaccagcctcataagaagtcagtacggagctcccaccggattgtgtatataccggaggtgcgagcattataatagagcttcaagttatgggcgtgaattacacctaggtggaaaggaggtcaggaaagaaatagaagatacgatgtgagattttaaggtaagtaaggtaaaggtgaacaacatacgagacactcaaaggcaaaagatcatgaatagtccatactttggatagaagtctataagcgcggatatccaataatcgggaatgatagtggtatcgtcggcaacatgtcttccaaaatatcatttctaagtactaagagatctagttaagagaatagagaaaagttggagacgatgtgattcctcgcttaatgttctaaacattaagcgatcgcgatcccaaacataacaactttgccttaggctttagaacccgtcatgtattcacctaggggaaagtcactttcctagtgcctctttaaccatttagaaaaccttacaagcattcatacttagcttaatttcgcatatcattagcataaaattagaagtaacaaacaacaaatatgattggaagtgtaatcaagagcactacacactactagattagatagaagaccaactccaaacattgttgtagctccctgtggattcgatcccgaccttcttggataaaagtagcttcgaccgctctcgccactctgtagtggtgtagggttggacccaatcatattttacccacagaccgatgggtagtcagagcgaacagttcatatattggaggacgtgctcagagcatgtgtgattgactttgggtgttagtgggatcaattcttgcctttggccgacttacaacaatagttatcagtccaacattgagatagctctatttgaggctttatatggttggcgatgtcattctcctaatgggtggtttgagctcggcgaggctaagtgttacatcttgcagtattacactacgatggtgttatgcttcgcagcattaagttacgacgatgttgcaccatgtagtattgtacgttggattttttgtaaggtaattgacatcagtccaagtaaaagattgtttgaagattataaagattatgctatttcacaagtgatgaataaattcgtaaaggtgaaaggggaagcaagccaaagaaaatgaaatttttcgtctaagtttggcatattggggtaaaatacggcccgagctaaaatatccgatatttatggacttgcgacatgcaagtcactacatgtccatgctagaaagatgtataaggtatgtgaaaaatgagtaatattttaagtaagtgggaattattctcaattttttgggtaattagttaattaccgggtaacatgacattacccaattaactaataagtggataagattaaatcccttccccccctcccccaacaaaatgtggcaaaaggccactatttgagaaaatgactcatgttgatttaagagtaggtggctgccaaggatttaatggaaatattaaaacaagcaagacttagtacatgtcttgtttctatgattcatttggataagagcagaatgtctttgagtcaaaatagaaatcctatctccatttccattttggaaaggagtaacgcagccattctgcaaaagcaagaaaattttatttcttcgatcaaatactgtaacgtcaaagaacataggaaatcgttcaaacacttcaataagcagaagcctaattttgtcaaaattttgtgattctaacggagtacggtgcaatcttttccaagaatatcatacgaattttttcctactccaggtatgttaaggctaagcttttccttcatgttatcatggtgtcataattactcaagttcgataacgaggcatagagaaaaattcataacccgaaatttgcatatttttttgctagtctcgcatattgcgtatattttcctagttttataagttataatattctccttatcgggacttcatatttagttgagtattttcttcaaccagtcaagagagtagagaatttacatatatgcagtattaaaagtattttcattaccatcgagctataatcgatgggtaggcccctattgggcaacctctgatcagatggtaagttatatgccgatcctattatggctgaacgcctatgagcgagcccagttggttgagataaagagcctagtatggccgagcgcttatgagcgaacccactacgacatagtagctatatatatatatatatatatatatatatatatatatatatatatatatatcgagccttatagggccgaacaactattttactcactatattgagagagttgagtcaatatcagcagataagcatatcttcagattttcttgactcccagttgtttgcagttattatattatttgttcagtttcagcttcagcttcagtatattgccttaactcggtacattatttcgtactgatgtccttttctggggtcgctgcatttcatgcatccaggttcagacaaacagacgggtagacctcctcagtaggtgttgcccgagttcagctttattggtaagctccccttctttcggagtttccgggtctagctatgtggtgtgtatcttatgtatatatgtagatatgttatgggtaggtcggggccctgttcctatcatagtacatctatcagtagaggtttgtagatatatcatgtcagttagtaaagcatgttgggctcgtaggccctgtacatatatttcgttggcttgtcagttgtagtaattatgatggccttgccggtccagctttatgttgacatttagtcatcgtttatctcttttcagctttatattttgcatcgcacattatcttgcaatgtgacccatgaccaaagtttgatattacatgttcagagtctcttagtcgaaagaggtatgcaaggataattgaggcgctgggtgtcggtctcacccccaggctcggggcatgacactaagttctatggtattgatttagtgaaggattccttggaaaaggtaaagttgattcaggagcgacttcgcacagcacaatccagatagaagagttatacggatcaaaaggcacatggtgtatcatttatggtcagcgagaaggttctcttgaaagtctcaccgatgaagagtatcatgagattcagaaagaaggacaagttgagcccgaggtttataggcccatttgaggtgttgaggcgagttggggaggttgcttatgagcttgctttacctcccagcctattaggggttcatccagtttttcacgtgtctatgctccggagatatcatgccgacttgtcacatgtgttagatgttacaccccatgtttccgtacgtgaaagtacgccatatgtaaattgatgtaagctcaaaaagggatgaattctttctacaaggctaaggaaggtttatcaaagtattgggtaagttaggatgaatgaaacattttaatcatgatttaagtgagtttaaagtcgtgaaatggctatatatgatgtttggatatgaaatataaagtttgagaaaaatcggatttaagtcgtggaaaaactgactaaggatttgccttgtaatgaagcgttttgagcaatacattttatgtgctatatgaggttttttcgggacatattatataccaaaatgaagatcttggaaactagtttccaacagtccaacccatttattcatacgacatcggggcatagaaatatggatttttgagtagggtcgccaagtcacgttgccgcacttgggagaaactggcaggtttataggacatgttgcgacacagttttctctaaatatatttagagttacatggatatctttattattgaattaaatatctatgtgtcgagtttccatcactgcaaatgatttgtcaatatgatatcagagtagagagatacaagtgtccgaagtggcactgctcaagcttccaagcaggtagcttacccacctgcttggagaattgaagtggtgggcttataagttgtctttactcattacatatagtcaatataaaaatatttcttacacaaaaactctctcaagctctccaagaactagtccaggatcttaagaaccaaacttaagagaaatcaacacaaatcatcatcaaagatgttaaagattacaagagaatgcttctatgatgttgtggtgtgattgagggctattgtgagctaagttgatatagggttttgagttttaaatgttgtacaaggtatgtataacatcttcttgattgtgcctaaggttaatcttgtgttggctatgttgtttgagtaaaaaaccataagatagcacttgaaagaacatgggatatggttgtctttttggctggacagttttgtggctaaatatatggtttgtggtggctgaaaattgtgagaaataatttgataatgttgtgactgctgttgttaagctttttcaggtgttaattaagtttattgaagaagaaacgataaaaaataagtgattgacgataaaaattaaggtgctagacgtatagggctattttggaaggcattttgttgatgttttaaactagaaataatatggtacatataagtatgatattctgaaggttgtaaactaatttatggaataagatttggatttaagttatatcttattatgagtaaaaacgagctcgtcactcaatatgattgttaagataattggagaaactcatattggattatattgttgttgttgctattgttagttgtagttgttgtattgggatgttgatgaccctttgtggtctttgagatgaattaaaaaataggggaattgctgcccgattttccttatgtcatacaactagccaaatacgatggtacgacattatatgttaacgataatataatttcacctgttgtagatgcaagaagttgtgctgagcttggttgagcaataaggaagagctcatacaggtatgttaaggctaacctttcttcttttggcatgatccaagaaatgatacgtaaatgtaatgctattccataagtgattctacccttatcagttaaggatatctacgttactcattcctataaagtgatattcaagcatgtctaagtatgtccccaagtccctattgaggtatatgatagagatgttaatgtttttaatatagtgatacatgcattttcatgcatttaccaccgtgctacggtcggtcgggcagttactaccggttgggcagtcatgcatattcatttaccatcgtgctagggctagtcgggcagtcatgcatttaccaccgtgcaaaggccggtcgagcagttaccactgatcagttgggtagtcatgcatcgatatggataatggttccaaataggttatatatatatatatatatatatatatatatatatatatatatatatatatatatatatatgcatataagtataataagtatgaatatacggtagcactgcagaggttcaggtgattcttatatctctttcattaatgctgacttatcattatgttttagttctgtcttacatactcggtacattatttgtactgacttcccttttgctgaggcactgtgtttcatgccatgcatgtgtagataggcgaggtgaggaccctccactgtaggctgcctccagatatcggcttttggttggtgagctccagttcttcctggagtattgccgagtcacgttctatgtatgttatttcgttttatgaggatgtcaggaactctatgccgacttatatattatggtcatgtttttctagaggctttgcagacagacatgtcaacgtccttgtcggcccctatgtatctatataaatattttagaattagttatgtgagttaagttctaatattgttacttatatatatatatatatataaagttaagttctaatattgttatatatatatatatatatatatatagagagagagagagatgtggcttgtcatggctcatgacaagtcttatagtaaataaggataaggtacgtggcgctcgattgagtaggcaccaggtgccagtcgtagcccctccgatttgggtcgtgacattagacttcagcactattcagttagatgagagcttggattatgaggaggatccagttgctattgttgctagacaggatcgctagttgagatccaagaggatttccgcggtaaaggttcagtggaggggccaaccagttgaggaggcaacctaggagtctgaggaggacatgaagagcagatatccacacttattcaccacttctgatatgaatctaaacccattcgagaatgaatgtttgtttaagagatggagaatgtaacgttcgaccgatcattttgctttctagattcccgttccataaataagactttccgtacttgattttactattttatgacttgcggggatgtttgatttgggatttggaagagtttaggttgaaatcataactcttggttccttaaggttggcttaaaaggccaagtttgacttcggtcaatattttgagtaaacaacctcgaaatacaggatttgacggttccaataggattgtatgataattttagacttgagcgtatgttcggattgagttttggatgatgcgacagcgttttggcgcctaatagtgaaagttggttcttgaaggattttgaagttctttaaatttggagcgggtttttgtgatattatggtccaaacggaatttcgagactcagaaaagttccgtaatgtcatttaagacttgtacgtaaaatttggtgtcattcgagtagtataagtacgtttcagcgcattggaagtaaattgaagaacttgaagttcttaagtttgattcaattgttttagggtgtgattcttagttttaatgttgttttgggcatgccgagagtttgagcgggtccgttttatgattccaaacttgttggtatgtttgggcggggccccaagtgctaaccggacgaggctcggaccaagttgagatatgggaaccacagctaagtgcaccaggtctgtcacaaccgcacctgcagttggtcagccacaggtgcgagctcgtaggtgcgggctatgcatcgcagaagaggccaaggaagggcagcccaggttccacagatttggcccctcctccgcaaaagcgggacagcagaagcggtcacccgaccgcaaatgtgacccagccggccagggcaattctgtagaagcagacccttgtccgcagaagggggatcgtagatgcggttctgtgatcatagatgcagaagtcactggggaatttaatatgggacttaggcatttttgactcatttcattcaattgttgggcgattcttgaagctcttagagaggagattccacccaacaccttgaggtaagtgattcctacataatgcagttaaatacatagtttatgggtatattataacatgtgaattggtagaaatcacgtgtttaggtgaaaacccagggttttgataaaatgatattttaccacgaaaatggttatggaacttagtgaaaatcatatatttatgttcctaaggttatgggtaacaactttcttcaaaatttccgaaatccgggcacgttggcccggggatgaattttaggaatcttgcatttagagttggaaaattacttcaatagttgggagatgaacttataagcttatattgatgagtttttacactatttggatagttttggatcgttcgacaccaaattgagggtttgggcataagcatggaccggaaagtaggccttgaaattttcctataggtgaacttaattaatatgtgattagttatgggggttacgtacgcacagagtgatgagagtccgtatgtagctactattcttgattatgtccgggtagttttaggatcacaccatgcttgaggataccattatttgattatatttgttattgtgatagatggaaccaagttgagaattttcaaggattttaaaagcttcatgttgaaatgtctatatttttaaaagaatctagaaaagtgttacgatttatttataaattgatatttgaccacgtcacacgtattatccgcaagcggagtaattccttgaatttatatttgactgcgtcgtacatatgatccacgagcggggtaatagatgcatctatggttcacaccattggaccctcgccagtgcacggtttacatttatgttggatcgggccgaacgtcctcggtggtattcgtgtgtgataatagaactagaaactttttataacttgtttgaattgttgtcgagagatcacttgttttaaataaaggaagtgctttggattcttaaatatgttggaaggattgttcagttatttatctttctttttttgagcttgttgttatctccatatattatgcttaaattagaaatttcatattattatattgttggccacaataagtgtcagagtcgatccctcgtcactgcttcttcaaggttagaccagatacttactgggtacatattgttatgtactcacgctacacttctgtacttaattgtacaatatttgaggtaggtgcatctggtcaccagtcaggcgcgtagatttgatccccctttcaagacttcacggtgagctgccttatgagccattctacaacagctggagtcttctttatgctttatttttctgtatattttcttccctactaatgttcttttgtacattctactagatttctcacatacttgcgacaccaggtcttggtacacacactagtagacttatgattttggtattgtatacatgattacggtttatattcgttgcttccttttaacttggcttcattggtaaatttctaaatcttttaacaaatcaagaattttatccacttagtaatttatttaagtggtaaatcactagtttgatcagtgttgggttgcttagcaatggttgggatccatcacggcctatgatgaaattgggtcgtgacaaggtcacatagggcaagatcgaatgaatagattggctaaggaaggtcatttaggttctttctctaaaattgaaattccaacttgtgaaaattatcttaccggaaagattacacgtaaatcatttggaaagactaagagagctgatttcccatagcaattaatccattctaatatctatggtctaatgaatgtgggggctaggtcgggtgcttatatttcattatgttcattaacaatttcacgcgatttggttatgtctatttgtcacgaacctaaactcaaacctgttgtgatggcgcctatcaatagtactaggccagccgacttccaaaataccacaataattcattaaaagatatgccaaaagacatcatgtttagcagtattccataaaaggaaaaccagagttgaattcaaagatagaaatgcaaaaattaaatccccaaacagcggggtatcactaagtcatgagctactactacaattattctgataacaataaaactaacatagtatgggaaaggttgaaaatacaactacgaggaagatatagaagaagaaagcagggttgcggtctccaagcaactacattattatctctagtgattagcagccactaccgtggcctgatatacctggatctgcacacaaggtgcagggggtaacgtgagtacaccaactcagtaagtaacaagcctaaactatggactgataggtagtgacgaatttaacctcaacggtaaacaagaataaactgtatagaaagtaggcatgctttcaattcaagtatttagctcaaacagtaaagtaaatacaactctggatattgtgatatatatacagtccagttaacctctacgtgccaatgtacagaatgtatgaaatccactatgtacttccactctcaagtgctcaaccactcggtaccgtatatggccatctagcctagggaggatccatcttggaatatatacacatcactgacaacagtcactcagtaccgaggaaggccattctaaccatgtggagaagatccatctctaggtatcaatacttcggacaagatcaatatctagggaagatcaatccctcaataatatcatttatgcccactatgggtgtgcagactccggaggggatcctaaggcccaagcgctatcataatcaatataactattgtggtgtgcagaccgaccccataactgtcactcataatcaagatctcggcctcactcagtcattcacctttatagtctcaccacgggctcacaatgttgtgaaaacaatccggaacaatgatatgattaatcaataactaaccgagactgagatatgctatagaaatgcatgatcatgactgagtatgggaaataagcaaaaactagtgagacgacaacatgaaatgatagctaaggtccaaacaataccggcacaaggcctaaatatgatatctaaaatgatttgcagctcaactatgttattatataatgaacacatggatatcaacaggataaattaaagtcagtaaaaaatgccatggaatcacccagcccataattctcacggtgcatgcccgccacttggcatgtgcgtcacctcagtactaatcacatgacacatagttcggggtttcgaacactcaaaaccaagtttggaagcattacttacctcgaaccaagccaaaatcctactccgcgatgcctttgcctatcaaatcggcctccaaacataccgaatctagtcacaagcaaaataacgcaatcaatataggccaaagaaccaattccaaaagaaaaactattcaattggacatagatcccgaaatcaactcaaacccatccaccgagcccacctctcagaatccgacaaatgtcacaaaactagaaagcccattcactaacgagtatccccataccaatttcttcaaaatctgacatcatttggttcctcaaatccccaaattactctctccaaattccaatccctaacccccaaattttcacttcaaaattccactaattaggtgaagaaacaacgggaaaacaccatagctaaagataatagagctcaatcaacttacctcactgaatgcccttgaatccccttcaaaaatcctcccaaaagctccaaggtctgtgttaaaaatggtgagaatgagcaaaaattcacgaaatcttgtatttataccttctgcacaggtttttctgcacctacggcataaaatgcgcacctgcggtgctgcttctgcgtaaaaaccttcgcatctatggaaaaacacttaaatccctgggaccgcatctacgactaacgactgcatctacgatcatcgcaggtgcgagaatgacatcgcacctgcggaccaacacatgcacatgcgccatctcttccgcttctgcgacaatcgtaggtgcgacgaacatatcacacctgcggactatgccagaccttcttccttttgcttctacggtcacattctcgcttctgcggctcgcacatgtggtttccactccgcaggtgcggttatgacagctgatttccaaattcagcaaatctccaaactttaaacttgatctgttaaccactcgaaacatatctgaggccctagggacctcaacctaacataccaacaagtcatacaccaacctacgaacttggccaagccttctaatcactcaaaacaccatcaaaataccaaattaccctcagattcaagcctaagaacttctaaacttccaaattttgcaaacgacgccgaaatctatcaaaccacatccgaatgacctcaaattttacacacacgtcaaaaatgacaccacaaacctactccaacttttggaattccattctgaccccaatatcaaatttccactaccgaccaaaattgctaaaatccaaactttcgcccaatttaagcctaattctaccacgggcctccaaatcacattccggacgtgctaccaagtccaaaatcacctaacggagactataaaaattcacatccgtgattgtttacacataagttaatatctggtcaacttttccaacttcagccttcacaaaagagactaagtgtctcaaatcctctccgaaaccactccagacccgcaccaactaacccgacatatcataatatggctgaagaacccaaaaagaagcagaaatgggggaatggggctacaactctcgaaacgaccggtcgggtcgttacactatttgatttcttataaatctgaagcacttgaatactttaagaaatatttgaatgaagttgagaatcaattagacaaaagtattaagaccttaagaactgatagagggcatgaaatctatcaaaagaattagaattatgtaatgaaaagggcatcactagataattaactattccttacacacctcaacaaaatggtgtagcagaaaggaggaacaaaacactattgacatgacaaggtgtagcagaaatgagcatgcaaatttacctatccccttttggggagatgcgttattgactacagcctacatactgaacaaaatgccttctaaatcagtttcttccactccttctgagctttagactggtcataacccaaaacttaaatgctttatgaccttagggttgtggtgcatatataaatttttttagcaagtttggtaaattaggtccaaaaggcaagaaatgtatctttataagatattcagaacactccaaagggtatgtgttcattggtgaattagaggatggaactgttattgagattgaatctcgagatgtcacatttctagaaaataattttccgaagaagggagagctaaagaatgtagtggctctttaagaaatgttgaactcaaatagttagcaagtgtcttctgacacagttgataatcaaattgatcataatcttgttcttgacccgaacaggattggtagttcttgatcgggtccaaccctacaccactacaaagtggcaagagtagtcgatgtagcttttacccgagatggtcgggatcgaatccacagggagctagattgattgggaattggattcctatctaaactagaaatgtgtactgctcttaattacacttccaatcataattgttgtttattacttctaattttatactattgagatgctaaattaaactaagagtaaatgcttgtaagattttctaaatagttaaagaggcactagggaagtgactttctcctaggtgaatacttgacgggatctaaagcctaacataaagttgttatgttagggattgtgatatagccaatgaacggaactactcactctatacctctcggtagcttgagtgactttaccctattgactttctcaagaccaattgggtgtcaaaattgtgcaagcaatataggctcaagtcatgtattactatctctaggtttaactctttaattggggctatcaatctcttgattacaccccaattccttgttggactgatgttcccagactcagctctctttctcaagaaaaacccaagtcaaataggcataaattagtattttcaaccaccaattcaacatggaaaacacaaatcagtccaaacatcaactacccataaacacctaagccttagaacaacatacccatcaaatacccgcactagggttgaaccacaaccctagctaatggctctagctactcataataatggaagaaaacagataaatagatgaagaataacccatataatttgattacaaactaagaaattgaagattcagtgttaaactagctacaaattactcaaaatggaataagatcgccgttcacgtgctctggattctaactgataccctaaaaatataaaaagaaagtatttatactaggccaaatatttttggacaaaaataaccctggcggaggtattgcggatcacagaaaatgcacagcgaccgcgatgaggctttttagctaaaatgctcagtctctgaatctggccaccgtggactgcataaaatgcattgcggcttcactgcggtccgcacaaaatggactgcggaccgcattggcttccaatcttcaaactaccaactctttgaatcccctctctgtagaccgcataaaatagattgcagccgcgaagagtcttctgcggggctgggagaaatccttcatggaccgcacttctttaagctccaaaagtgcccctgtctgaactcatccactgcaaaccgcactaaatggtctgcgtctgcggtgagtcttttgcggctgtagtagattttattctacagtagtgtcgtgacttattcttggtacttgtgtaggttttactcctttttgagctggttttgactacttgtcactcttttgaccaaaccctgcaaacaagtacagcatgtaagcctttggggctatttatatacatttttaatccaaaactcaagtaaaaaggagtgtaaaatgaactagaatccctagttatcaactcccccaaacttaagcttttgcatgtccgcaagaaactaaataagtcccacctccttaagagtaaaaccaagaaaatttagctgacctaaagtgacctcatctaacatcaattgggactaacaattgccctcaaatcaaatgaatcattaacaacattcaacttttcaagcaccatggttttagtgcgacataagagcatcaagagttgactcaacccatcaagaaaactctttctactactttggtcattgtggaacccaaactcatactcctcaactctccataaataaacctcacttttaggttgtagcactcagaacgaggattgtgggaaacacactcatctttctcaaagaaaggtcataagtacggctctaagtacgataagctttccccttatgtgagtcaccaataatgtaaggttcattcaactcaagatcatatagggcttttgtggagatataatgaaggcttttggttcagggtaggaaatatttggtctaagtaggttctatcttcccttaagtacttcatttgcttcattttggcacacattctcttgactttttgagtcatttacttctttcttaggggttagagagacacattgtcactcttcttgttcatttcaaaactttttctcctttctaaactttccacacctttcatctctttacttatattgaatccctttatttcttctacattgttcattctttttttgaccttttaattttctttctttttcattgcctttccttttcttcattttgtaccttgtaccactttgttgcattccttgtctctccccccaaacttatgcttttgccttgtgctaaggaaagatcgggtgccaagagagggtcttttttgaacaggtaaaggcttgtatcatggtctttgaaagaaaaaggctttggctcaaaagggttgaatagggatattatcattggtaggctatggaagttttcaagatatcattcggatcaaggagagcctataatcacttctcaagtcaaactacacttaggatttcgcctagataaactttcagggcaagttctagactaatggcatgtgacttggacttgcaattcaaattctcaccacataagctataggattgctaaagagacagagtcaggggcgcacaacaaccttagctaagatttgagcaacacgaatggtcccgaaaaaccacttgatgattatcggccaacacaagagtctcaaggtcagaactttcaccattccatacacaataatttagttttgaccataaaatcaaaggcaaatgtgttaggcccaagtgaagctttacttgaggcaccattactcattagctactatttacacataaacaaaaagaaaaaagactcaaacctttaagaaggttttcacgccatccatcatcgggaagagccacctggttcacacaaattccacctttggaaagaaccgtgacattaagaaaatcaaaggcttattgcacgcaaaactcaaaataagaagctacgaagataaagtaagaagctatgaaagaaaatgcagaaagtaaaatgaatatgtacaataggggatttagacgaatatacataaggggcaaatgaatatatacatcagaaagtaacttatatacataccaaagttgtaaagtacgaaaagttcaataaactagtaaaactatatacataccaaaggtaaaaagaaagcataataaaaagaaagtagtatcatatttacaacccaatgtcatcaaaatagggctaccccctcgaataaaagctagcattgtcctcaatgctaactaacctaaaatagctcaataaaagatagagagtaaagagaaactccctattggccctccgtctgcatggggtcatgagcctgagtccccgggtcctgtgactactcgagaacttgtgacgggatcccaatatcatgttcctacactgggacctgaggcttctctagggcctgaggctggctagaggaacctccctgcgggtcctccaactctatcactgcatcatcaactcgggggatcaccttcttcctctttgttggtctctccatctcctgctccggctcaggatgggctgctagaatcgggtcatgtaataacaactccaatggcaaatgatcagccttcattttctccacttcacccctcaactccttcacagactcctttgatgctcgagtctttctcaacttctttgtttccttcgccagctccttcagtgcttttccataagtacctatatcatctaatatcaacttctggttctccaagcgcttcttctggttgtccagaagctccttgagagtcttctccactaaggctgggacctgtggctgagggggtacggactaggctgccactgagatagaaagcacagacaacttagaattagttgtctgcatccagttgttgatactggaaaaggtttggcttaaatggtgggcagtcaatgggtaagctgaggatgaggggatatttggagctgtggaagtagagggtcctgatgaaatgtatggtgtagttgagagaggctgagaagaagctactactactactactagctcttcagactggccagtaaaagcagtggctttgcctttaggatctttggggttgtcatccctcttgaggctgtaccaggagaaaggtaccttgggtttcactttcacatcaaactttcttttcttcacatcttggtcctcaaagtacatggtcaggaaatttgggaaggggtaggatctatcaccttcattcaccaccctcgtgatcaccctagacataacattcccaacgttgatcgggtaccccgccatgatagatgccaccaaaattgcccgggagataggaagagagttctcatgagtggtggggtccagcctgctgcaaacaaaagtctcccacccttttgccttgaagtttagggttctcctcaaaatttggactcctgctgtcaactatgctggggtggtaactaggagtgccaagtactcttctaaccacggacgagcattctcacccaatgctacctttttaggtataatatttcatcctcctccgaaaagcctaggtagtcgttgattgtcttgccatcaaacttcactgtcaagttttgcaccttagtcactttcgtgccccttttaatgtgggcaacattagcgtagaattacttgactaggtgctcattttcctcctcaacgttgcctgtaaaatagtcccatcccggtctctctctaaattgcctctacacattagggttgtgaggcagaagatccttgccaatgaatctccattcaagtattaacttcctcttgagccaccactctcagaatttgtggtaaccaatctcactgacaaatcttcttttccacacctcagggtttctagttttctccacaccccaggttatggcacacaccctccctcttcattcagaacctcatcatcgatgggatcctctccaggtgatgaaccagtaggttaggtagatgcttcactgtcactaccctcagctgagccctcagacgactcagaagaaattggaactgaagcttgagcagtaggagtgcccggaggtgtatctctcaatctacgcctcttcaacctatcaggaacatactctggcactgaatcagactcagatgccttttgggagggtacatactcacttccctttgaatggtaagcagctctatttgcaacctttattgactttctagtttccttaattgcctgtcggacttgggggcaatctgatcataccacgtcccctaccctgggaggagtctcctttgcctttctgtttatcacctccgcctcgtgatttaaccattgtctgcaaggagaattcatttagtatttgttagtatcaaaaccagaaaaagcaatgaagagtatgattgcagatagttgatagtgtaaagtagaactacagaccgcagtccacaaaaaatgcaatgcggacacaaagagaccaccgcagactgcacaaaatcgcatcgcggtccgcattgaggtggggtcagaatacccactctctaattcagggcaccacggacctcatgaattgtagtgcggtcgtggtaaggcaccgcggactgcagaaaatccactacagttgcggtcctcaaaccttacctctatgaagatttactaccacagtccgcataaaatagcatcgcggactacatagaggcaccgcggacagcagaaaaaccatcgcggtcgcggtaagaaaaactcaacaataccaacctagggtttcaacattcttctcatttttagcctaaattcacatattgtaaacccactaggttttcaattatcattcataactaattaaccctaatctaaataacttgtgcaatcataagctaaaaatttaaagaaaaaaggaagaagaagaagacgtagaactaacaaattaaaagaaaataaaacacaattgaagactaaggaaagattaaaagtaccagtaatgagatgcacacagatgaaaatgaatcagtgattaaattcgtgcagctaggcatgatgaatattgcttttttttctatttggaaagcaaatgagcgaaaagttttaaatgaaggcctaaggtcctatttatagaaaaaggacataggacccactatacctacccaccgcgaaccgcacaaaatacaccgcattctgtgatactcaaacatatgaagcactggggaggcattcactgtggaccacaagaaatgttctgcggccgcggtagggcagcgcggatcgcataaaatgtattgcggccgcgatgacaatctttagagaacctccactttctaccatttaacacttcaaccgcaatgagattttgcccccgcaacaaggccactgcagccataaaaagtacattgtggcagcagtccaaacttcagagagtgcatcatttttccactttggtcctgcactgcatcaaaacaattctacacacatatcacaaccggttagaccaaaagaaaatcctatagtaaaaagaaaatcaaagaaaaacaaaaagaaagacacatgggctgcctcccaagaagcgcctgatttaacatcgcggcacgacacaggttaccatcaaatcactttagacggagcagtgccaccatgtggctgtcatcaatcttgccaagttagtgcttgactttgtgcccattaactctgaagacctccccatttttgcttttcaagtcaagtgcaccaaaatgagtcacaaacaccacttcaaaaggtctactccatttcgacttaagctttcatgaatataaacgtaaccgagaattgaacaagagaaccaaatcacccactttgaactccttgacacgagcatacttatcgtgaaggtacttcatcttgtccttgcacaaggacgaactggagtaggcatggaatcggaattcatcaagttcattaagttgctccacatgaagatttgctgtcacatcccattcaagattcagcttcctcaaagcccacatggtcttgtgcactaactcaaccgatagatggaaaagctttcccaaataccaaccagtatggggacataccaatcagagtcttgtaagcagtactataagcccatagagaatcatcctatttctttgaccaatcggtcctatttgcattgaccgtctttgacaatatactcttgatttccatgtttaagacttcaacttggccactcgcctgatgatgataaggagtagaaactttgtgattgacaccatactttacataaagtatcaaaagctcgattacaaaaatgagaccccccatcacttatgattgctcgaggagtgccaaaccaagtaaaaatgctcttcttgagaaatgcaacaacactccgagcctcattgttgggcaaagtcacgacttcaatccactttgaaacatagtcaacatgtatgtgttcccacacgaactaacaaatgagcccatgaaattaatgccccacacataaagaatatcaacttcaagaatggtattgagaggcatctcatctttcttcaaaattccacctgttctttgacattcgtcgcatctcttcacaagttcacttgcatctttgtacaaagttggccagtaaaacccacaaataagaacctttgaagccgtcctcacccttccatgattgccactatagggagaggaatgacaagcctctaagatactcaattgctcctcctccgggacataccttcggatcacaccatccgtgcagatcttgaacaaatacggctcatcccaatagaagtccaaactatcccgtttgagattcatcctttagttagaagggagctctcacgggattataccagtcacaaggaaattagcaacgtccacaaaccatggcataccattcaccgacatagaagggattttctcatcagggaatgaatcattgatatctaggccatcacgaggcgtcccctcctcctccaagcgggacaagcagtccgccacttagtttttactacacttttggtccacaatatccaaatcaaactcttaaagtaacaagacccattgcatcagcctagctttggaatccttcttcgtcatcaagtaccggagtgcagcatgatcggtatgaactatgactttggcacccatgcgatacggccgaaatatctccattgtgaacacaatagccaaaagctctttctcagtatccatgtagatcacttgagcatcattcattatcttgctcgcataatacatcggatgaaatattttattcactctttgacccaaaactgccccaattgcaacatcactcgcgtcacacatgagctcaaaaggtaagctccaattgggtgcggtaataataggagtgttggtaaacttgtgcttgagaatttcaaaagcttgcatacatccctcattgaacacgaactttgcatctttttccaataatttgcacaagggattaactacctttgaaaagtctttgataaatctccgataaaaccccgcatgcccaagaaaacttctaactcccttgatagaagtaggggggagccttgaaatcactttaatttttgctttgtccaccactataccatgctttgaaattttatggccaaggactatgccctcctcaaccatgaagtgacatttctcccaattaagtacaagattggttttttcacaatgggccaacactctatcaagatttttcaaacattcatcaaacgagtcacccacaacactaaagttgtccataaacacctccaaaatgtcctccaccatgtcggtaaatatgaccatcatacaccgctggaatgtagtcggtgcattacataacccaaatgacatcctagaaaaggtaaaggtaccatatggacaagtaaaggtggtcttctcctgatcttccgaagtaatcaaaatttggttgtacctagaataaccatccaagaaacagtagaaggaacgcccagcaagtctatctaacatctgatcaagaaaaggcaatggaaagtgatccttgcgagtcactttattcaacttgcggtagttcatgcacaccctccacccggtgacagtcctggtaggaatcaacttattttgcacattagtgaccacgatcataccaccctttttcagcacacattgcaccgacgaagtctaagagctatcagagatggggtacacaaccccgacatccaaccacttgatcacctcctttttcacaacttcttgcattgcctcgttcaaccttctttgatgtttgaaggagggctttgcatcttcttcaagaataatcttgtgcatacaataggcggggcttattccctgaatatcaactaaggtccatccaattgccttcttccgcttttggagcaccaccaatgtggcatctacctgcatattagtaagataagaggaaaaaataactggtaaagttgaaatagggcctaagaattcatacctgaggtgtggaggcaacaacttcaactccaacaccggaggttccttgattgagggctttgttggtggagttttcatattctcaagatccaaagagagttttcaaggctcataagagtaagagcccatttcatgtaaagcattgacacactccacccggccttcatcctcatttacatcaagattcaacaataccgcctctagagggtcctccatatttatcattacactagtattatcaactatcactaccatgacaagatccacaaaagagcacacttcagaactgttgggctgtttcattgacttgcacacataaaagaccattttctcatcacccacccggaaggtgagtttcccttcttccacatcaattaaggcctttccagtagaaaggaaaggtcttcccagtatgatcataacctcataatttacctcataatccaagatcacaaaatcagctgacaagataaatttatccacccggacaagaacatcattaattatacccaatggtctcttcattgttctatccgccatttgcaatcttatggaagtcggcctcaattgcctaatacccaaagtcttgaaaactaagtagggcatcaagttgatacttgtgcccaaattacatagagcttttgcaaagtctgcactcccaatggtgcaaggaatggtgaaagcaccgggatcttctagctttggatccattgagtgtactattgcactaacttggtgggtcatcttgatagtctcacaatccatggatcttttctttgtcaccaagtctttcatgaatttagcataacccagcatttgctttagagcctccaccaaaggtacattgatggaaaagctcttcatcatgtcaataaacatcttaaattggttctcatatttctgcttcgcaagcttttgaggataaggtggaggtggccttggcaaatgagccttggatttaggcacaaccgtttctggcatgtctattacgtgttccctaaacggggttcacgtcattctgagtttccacctcggcatcttggatatcaatcctcacttcctcattaacattcttatcaatcactttttcaaccaccaaagggatctcatcctcttgcaactcaacttcatcactcaaaacttcattttatttggaggcattcacatcaccgcctcgtccacttcatgtagttaccgccattacattcccagaattgttcccacccttcgggttgactaccgtatcactaggtagagcccccttagggcaagtatttaaggattgtgagatttggcctaattaaacctccaagtttctgattgaagtattgtggttgccaacatggcattagagtcagcattctttttcatcatttgttcaaacatgattttgattctccctatttcattgttagaagaactaggaccttggtatggaactgggggtggatgttttggttggtgatacatcgggggactttgaaagccttgtccccgatattcttggttgtaattgttccaaccgccctgattgttgtttccaccccagttgttgttgttgccattccaattaccctgattgttttgattattgatctgattgccccaatttgcattttggttgttgttcccccaattacttttcccttgttgctgatttccccaattgccttggggtctccattgttgtttgttggaagaatttcccctttggccttgatagttgttcacatattgcacttctttattatgctcatcataactattatcttggaatccaccactatcattgtcatattgatccgaactcccttggttctgttgacctctttgtcttcttttgttcactatcatgttgacaccctccatagcatttacctgtcgtaaattttgaacctgctgtaactgtgcctttgctagccggttcattgttattgccaactctggttttgccttcccatgatcatggagctcttttgtcatgacccaaactgaagggccatgactagcacccgaccacacttgccgagcaccaacgtacatttcatctaaccttcattattatcttttaaggctgacgagatcaatataaatggtagacctagatcatggacaaccagcaataaaatatgatggcatgcatataaatagcaggggatgaccagacaatcaagaaactacatataaggtatgagctaccacgctactatgaaagactatacaacaaaaactagccgacaaggcataccaaactatacatgagccgacacctgtctatgagcctctaaaagaacataagtgttgcaacatagccggaacagggccccgacatacccataatgtctataacaaaaattgcataccaagaccaaggcaagtccggagaagggatctcgccaatcaccgctgaactagatagtctactgtggtgggggagctgtacctgcctgtctatcaggacctgcagcacgacatgcagcgtccacaaataaaaggacgtcagtacgaataaagtactgagtatgtaaggcaaggaaccataaatgcgatcagtaatgtaagcaaggatagagaatatacaacccgtaacatcttagtacctctgagggctacttacatgaaatgcatgatacatatgtataaatacataaacctttaaagcattcgcctctgtgggcatcatcatcatcatatcgtacccggccataataggctcggtagaatcgtacccggccacgtggagctcggtaaaacccaactgatcagtggttgcacaataggtgccgtacccggccaactatagcgtggctcggtagagtaaaatagatacatatatataatgcatgctcgactcatagaatcacattctaaaccttttggagtgacgtaaggtcggtatcctctgtacacgttattaggactaactcttcactatgaaccttataagaatcaggaagtaccaataacattgataacataagaataagagaagcaacattagcatcaatcgttccataagagggaaaacaatgtaagtactgctagcttctaagagtagagtatctttgaaagctcgttcattacattatgtacaatcggagtcgtgcaaaagaaggaaagggatagtctcacataccttgtatatacttccccaatctcaagctatgcaattgtcaaaactccttagtctacaataagagaaacgatactatcgttatcatttaagcgtcataactattatgtatcgaccacaacctattttacgatgaaacggacagcacctcccctatatatatgacctcacaccattcaaaacaatcaccaaacagcccaaacatcatcaataataaacatattgagcctcccgaaatagtccacacacaacctaatcactccatacatacgacgaccaccgtagttgtgtcaaacaacctggaaatgttacgaataactatcagcccataaccctacataatatatggtgtttcttcacacccttcctcctccaaaactccacaagatagtagtaaaataagcagcccaacaacaacgcaaaacagtccacaaaacaataacattactaccaagcctttcggtatatatctcacaagttctagcttcaatggcttagccgcaacttggataatcttaaatacatatagagtaagaggttccttacctttatacagaaagaacaactccaatttgacctaatttccatgaaatatccctccaatgctgccacaacaacaacaaagcgaaactagcgatcaattagtgtttttcggcactagaatcactttagaaggcttgaaatcacctaggattgatattaagaacatgaggaagtatttacagaacataaaccctttaaaacaacctcccacacgagttggaacgacacaaaaatgagcaacaacaagaagaacaagagacttactagcgccacggaattcccgacacttgatttgtgttgtttgcccttttttgggtcttgaatcttgagagaaccttgagaggatgttcctagggttctaaggtctgaaaatagtgaaaataaatgacttaaaacgggttttagtcatcctatataggtccaaatatcttaaaccgacttagtgggccccatagagaggtgcttggcgcagtctcgcgaaaacgcgaatatctctctactccgagatcgtatcgatgaacggtttaatgcgttggaaactagactcatagatctttaatttagtgggtagataacccagtaattccttgtaaatgttgagaaaagattagaaacatttgacctaatgtttaagtaaaattatgaacctaagttgcgacaacttttgtcgacttttgtttcataactcgtttgacttcaagacttatgatacggatattatatgattaaaataccttcataaatgacctcttgagtgtattaagcaccgctagattacctgaaaatacaagttacaacatccttgattcttttaacttctaatactggttaatcacccttatacactcttgtatcacttaagaccaataggattgacttcttatcatctcaaagataattccttcttggatttatgttaactaatatatgtcatgaactaacacatgtggatatgggttgtaacaccctccccccttaggaacattcgtcctcgaatgtaagggtttatggggagtttaaatcatcgtggattccaatggaaatttccgatcaattttcccctataaaatggtcactagcaaaactttcaagtaattaagcccaacatatggtttcacaagtctacacaaagcattatgcgtatttacattatctacatatcatcattttgtattaaggaggagtattctcaaattattgcttacctcatagagccgtttcttcttccaatgtatcctgtcttccaccagcatccttgttatcttcattctggaataagtaagggtattttgacttcatctccttttctgcttcccatgtcatttcttccatatttttgttcctccacaatactttgacggaagctacatcttttgttctcagcttgcggacttgccgatctaatatcgccactggcacttcttcatatgataggtcctctgtaacttgtacatctttgatagagacgactcgagaagggtctccaatacattttctcaacatagatacatggaataccgggtggacaaattccaattcggatggcaattctaactcataagcaacctgtccaatccgtcgaagaattttatacggcccgatataccttggactcagcttacctttcttcccaaaacgcataatacccttcattggtgagatcctcaggaaaacccaatcaccaacctcaaactctagatcacgacgccggacatcagaataagatttttgcctgctttgtgccgtcctcaatcgctcctgtatcactttcaccttctcaatagcttggtgaatcaaatctggcccatataattctgtttcaccgacttcgaaccatccaactggtgatctacatctcctcccgtatagtgcctcgtatggggccattttaatactggaatggtagctattgttataggcgaattctatgagtggaagatgatcatcccaattccccttaaaatctagaacacatgctcgtagcatatcttccagtgtctgaatggtacgttcagcctgtccgtcagtctgcagatgaaatgcagtgctgagatttacctgtgtgcctaaacccttctggaaagacctccaaaagttagccgtaaattgagctcttcggtctgatataatagatatgggcacaccatgaagcctaacaatctccttgatatacaactttgcataatcttcagccgtgtaagttgtcttcactggcagaaaatgggcacattttgtaagtcgatcaataatcacccagatggagtcaaacttatgataagagcgaggtaatccaataatgaagtccatattaatcacctcccacttccaggtcggaatctctatattttgaagcaatccactgggtttctggtgttctatctttacttgttgacaattgggacactgggctacaaattctgcaatagacttcttcatattatcccaccaatactgctccttgacatcatgatacatctttgtcgagccgggatggatggaatatcgggattgatgaatctcattcataatcttctctcgcaaccctgccacattaggcacacacaatcggctctggtatctcagtgccccatcttttccgatcccaaaagccatacttttacactgttgaatgctttctcttaatcgtactaagataggatcttcatattgtcgtgcttttacctcggctaccaaagatgattctgatgtattctgtacagtaacacctccgtcatcagagtctaacaatctgattctcatattggctagctgatgaagctctttaatcaacccccatctacccgcctcaatatgtactaagcttcccattgatttatggctgagagcatctgccacaacattggctttaccgggatgatacaatatctcgacgtcgtagtctttcaataattcaagccacctacgctgcctcaaattcaactctttctgcttgaagatgtattgtaaactcttgtgatctgtgtagatgtcaacatggacgccgtataagtagtgccgccatatcttcaaaacatatattactgcagccaattccaaatcatgggttggataattcttttcatgcttcttcaatagtcttgatgcataagcaatcacattcccacgctgcatcaatacgcaccccaaacctatacctgaggcatcacaatataccacataaccttttgttccttcaggaagagtgagcactggtgcagatgtcaatcgattcttcaactcctgaaaactaagttcacaagtgtcagaccactggaatttggtagctttttgtgttaacttagtcaatggtgatgatatagaggaaaatccttctacaaaccgcctataatatcctgctagccctaggaagctacggacttctgatggtgttgtaggtctcggccaattctttactgcatcgatcttctgagtgtcgacactaataccctcatcagatatcacatggccaaggaatgctactgagttcagccagaattcacatttggagagcttagcatataatttacgatcctgaagcgtctgtaatactatccgcaagtggcccgcatgttccacctccgaacgagaatacactagaatttcatcaatgaatacaatcacgaacacatcaagatagggcctgaatatagtattcataagatccataaaagctgctggggcatttgttagcccgaacgacatcaccaagaactcaaagtgcccatatcttgtcctgaaggccgtctttggaatatccttctccctaaccctcacctgatgataccctgaacgtaaatcaatcttagagaaatacttggcaccctggagttggtcaaacaagtcatcaattcttggaagtggatacttgttctttatagtagacttattcaactgtcgatagtcgatacacatccgtaacgacccgtctttcttccgcacgaataggactggtacaccccaaggtgaagtgctaggcctaataaagcccttatccagcaagtccttcaactgcaccttcaactctcgcaactctgccggggccattctgtatggaggaatagagatcggttgagtgtcaggtaacacatcaatgctaaactcaatctccctttcaggaggaaggcctgggagttcatctgggaaaacatctgggaattcgttgaccatagggattgattgtaaagtaggtggttttgcctccacatccctaacgtgaacgagatgataaatgtaaccttttgagatcattttccttgccttaagataggaaataaacctacctttcggtgtagcaatgttccctttccattcaatgacgggttcacccggaaattggaacctaaccatcttcgtacggcagtcaacatttgcatagcatgaggccaaccagtccattcccattatcacatcaaaatcaaccatttctaactcaaataaatttgccgaggtttgacgactacaaatcatcacagtgcaacctctatatacccttctagcaatcacagaatctcctatcggagtagataccacgagaggtttacttatcaattcaggttcaatgccaaacttattagacacaaagggtgtaacataggataatgtagatcccggatcaatcaacgcatatacatcataagaaaacacagatataatacctgtaacaacatctggagacgactcgagatcctgtcgacctactagagcataggttcgattttgagcaccactcgaactcggcactgcacctctacccctaccacgacctgtcgactgctgaaaaccccgtgctggaggtcgaactgatgaggaagaaccagacacagatccagtcggttgagccataccatcacctcctctattaggacaatcccgcatcatatggccaggctgcccgcgcgaatagtatgcatcataacctcgacgacacagtccaaagtgggccttgccgcactgatcacaatgtggtgttgggggtctcatctgactagtatccctgggatgttgcgatccagatgcccgcgaactctgacctggaccagaataggatcgatcatatcgaggcctctgaaactgtggaggagcactagctacaggtggcgccgaactcctcgaaaactgtggcctgatgcggcctctgaagtcatcagaataccctgcaaatctcgccctcttatgctggcctctatcctgctccctaactgccctctgctggcgcttacgatcctctagggtctgggcataagcttgaatacgggaaatatccatgccctccaccaaggaggctgtcgtacactcatttatcagatgtggtcccaacccattcacgaacatatgcaccctatcactcatctcggccactatatggggagcataccttgccaaagaatcaaactgcatactgtactctcgcacactcatattaccttgtctaaggttcaagaacttatcagctctagctcgtcgtatctcaactggcaagtagtgacgaagaaaggcctcagaaaattccttccacacagctggaggagggttcggacccctggatctctcccaactatcataccagagaaccgctaaatcccgtaaccgataagaagccaactctactgcctctgtatcactaacatgcataacccgaagtgtacgatgaacctggtcaataaaagtctgtgggtcctccttggggtctgatccggtaaacactggagggtctaaattaataaaatcacgaactcttgtactaactggtttctcagcaacacctgtattctgcctctgagcctgagcagctaccaagctagtcaataactgcaaagcactctgcatatcctggtctggagtgccagacggaggaactggaggcgctgggtgccttctactatcctttggaggagatggagtagatgaggtatgagagggcatctcactttgagcctcactttgtcatgctctgacttggggcacctgactggtaccctctcccactgctgtatcaagccgtctactaatcgtttgcttcctagtcgaaggcatcactaaaaaaacaaggtgaatattagagacgaacacttacgactcaactctacgcacgatctagattcaggaagaaggtaacaaccctagatgtcatgtagcctcctgattataaatgtggcgcgctacacatccataatcaagactctacaagacacggctcatatacaacccctaggacagacttgctctgataccaagtttgtcacgacccaaactgaagggccatgactagaacccgaccacacttgccgagcaccaacgtacatttcatctaaccttcattattatcttttaaggctgacgagatcaatataaatggtagacctagatcatggacaaccagcaataaaatatgatggcatgcatatacatagcaggggatgaccagacaatcaagaaactacatataaggtatgagctaccacgctactatgaaagactatacaacaaaaactagccgacaaggcataccaaactatacatgagccgacacctgtctatgagcctctaaaagaacataagtgttgcaacatagccggaacagggccccgacatacccataatgtctataacaaaaattgcataccaagaccaaggcaagtccggagaagggatctcgccaatcaccgctgaactagatagtctactgtggtgggggagctgtacctgcctgtctatcaggacctgcagcacgacatgcagcgtccacaaataaaaggatgtcagtacgaataaagtactgagtatgtaaggcaaggaaccataaatgcgatcagtaatgtaagcaaggatagagaatatacaacccgtaacatcttagtacctctgagggctacttacatgaaatgcatgatacatatgtataaatacataaacctttaaagcattcgcctctgtgggcatcatcatcatcatatcgtacccggccataataggctcggtagaatcgtacccggccacgtggagctcggtaaaacccaactgatcagtggttgcacaataggtgctgtacctggccaactatagcgtggctcggtagagtaaaatagatacatatataatgcatgctcgactcatggaatcacattctaaaccttttggagtgacgtaaggtcggtatcctctgtacacgttattaggactaactcttcactatgaaccttataagaatcaggaagtacaaataacattgataacataagaataagagaagcaacattagcatcaatcgttccataagagggaaaacaatgtaagtactgctagcttataagagtagagtatctttggaagctcgttcattacattatgtacaatcggagtcgtgcaaaagaaggaaagggatagtctcacataccttgtatatacttccccaatctcaagctatgtaattttcaaaactccttagtctacaataagagaaacgatactatcgttatcatttaagcgtcataactattatgtatcgaccacaacctattttacgatgaaacggacagcacctcccctatatatatgacctcacaccattcaaaacaatcaccaaacagcccaaacatcatcaataataaacatattgagcctcccgaaatagtccacacacaacctaatcactccatacatacgacgaccaccgtagtcgtgtcaaacaacctggaaatgttacgaataactatcagcccataaccctacataatatatggtgtttctccacacccttcctcctccaaaactccacaagatagtagtaaaataagcagcccaacaacaacgcaaaacagtccacaaaacaataacattactaccaagcctttcggtatatatctcacaagttctagcttcaatggcttagccgcaacttggataatcttaaatacatatagagtaagaggttccttacctttatacagaaataataactccaatttgacctaatttccatgaaatatccctccaatgctgccacaacaacaacaaagcgaaactagcgatcaattagtatttttcggcactagaatcactttagaaggcttgaaatcacctaggattgatattaagaacatgaggaagtatttacagaacataaaccctttaaaacaacctcccacacgagttggaacgacacaaaaatgagcaacaacaagaagaacaagagacttactagcgccacggaattcccgacacttgatttgtgttgtttgccctttttttgggtcttgaatcttgagagaaccttgagaggatgttcctagggttctaagttctgaaaatagtgaaaataaatgacttaaaacgggttgtagtcatcctatataggtccaaatatcttaaaccgacttagtgggccccatagagaggtgcttggcgcagtctcgcgaaaacgcgaatatctctctactccgagatcgtatcgatgaacggtttaatgcgttggaaactagactcatagatctttaatttggtgggtagatcaccccgtaattccttgtaaattttgagaaaagattagaaacatttgacctaatgtttaagtaaaattatgaacctaagttgcgacaacttttgtcgacttttgtttcataactcgtttgacttcaagacttatgatacggatattatatgattaaaataccttcataaatgacctcttgagtgtattaagcaccgctagattacctgaaaatacaagttacaacatccttgattcgtttaacttctaatactggttaatcactcttatacactcttgtatcacttaagaccaataggattgacttcttatcatctcaaagataattccttcttagatttatgttaactaatatatgtcatgaactaacacatgtggatatgggttgtaacatctttgtgcaagtgaatgaccgtggggtcaccctgtggcacattggctctactttgccaagcgaaggacgtgtcagccatctcatcaagaatatcacaagcctcatcataaggcaacttcatgaaattaccccctgctaactggtttaccacacactgattggtcatgtttataccccgataagatgtctgttgaatcactgccttagtcatatcattgttggggcattccttgaccatagttctatatcgatcccagattgcatgaaggggctcatttggttcctgtttgaaagataagatttcatccatcaaagctgccatatgtcccagtgagaaaaacttggctatgaacttatcggccaactcatcccatgtagtgatagaatggttgggaagcctctcgagccagtccaaagctttccctctaagtgaaaaagggaataatctcaaccgaagcgcattatctgacagatttgttttcttgcttccccaacacgtatccacaaaacccttgagatgtttatatacattctgatgggaagcacctatgaaataccattgttgcaccaacaaagtcagcatcacatttgtaatttggaaattgcccacccaaatccgggttgggacaattgcactagcatatcctttgtttggaaacacccgaggagccactcttggaggtggcgggggagggtcgggaacattgtcattttgtggtgtcctcttcttagagcttgaggtactatagaaacctcatcatcaatattatcatctacctcctcccctggtggaaggtctccaagaggtgcattgtttgccgccattttgtacctaagtttgtgacatacacaaattagtaacacagaaggaaagataaacaatacacaaaactatttagatagatagcaaaaaccgttagctccccggcagcggcgccaaaatgtgatcgggtccaaccatacaccactacaaagtggcaagagcgattgatactgtcacgccccgaacttcggcctggacgtaacacaacactcggtgcctaactacctgtgactgagcaaccaactggctggctgaatcaacatgtaatatcataacatactaaatgaagaagataaactaacacatgcagatatactgaaagtctgaatgataaaagtcaaagtgtggaaacatacaagtctaaaacatgtatgtatccaacattgcttaacacaaaaagcttgtgactttgtataattgatactctagtctatgaagcttctaatgaagtactgaaaacattgactatctgaaaatactgaaaactataagataattataattccccgaaagtactgaggatcaccaaacaggtgatacgagagtcctagtgctttaaatcattaacctgtaaatcattacctacattgtaagatggaggccccgggcaaaagggacgtcactacatttgaattgcactggtatgtaaagcaactaaaagaaagaattataaatgctaaaactgaaactaagctgataacagagatttgataattgataactgaaatgataactattgaaactgaaacggaaatgataactgataactaaactgataattgaacagaacaaaggaagtaaggatatgaatactccctcttctgaatgatgaacaacttgtttatctgaataagctatagcctcgggcccaatatatatatgcataagctacggcctcaagcccaagtatacatatacgtaactacggcctcaggcccaaaatgcataaagcataaactacagcctcaggcccaaatacatgtgttcaacattcagggatttaaaatcaggaactgagaatcatactgcaatacatgagagtgaaatactgaatcacattgagttacatgatactggaatattggatcacactaagttacataatactggaatactgaataggactaggctgagacatgtattcttgaactgattatgaacactgaaacttcaactgtttatgacatactgagtaatctatactaagactcgggggcatcaaacccaagtctatattgaatacgcactgagcttgcaacgttcagaatgaaagtcatgaatgagttatgaagctaaagaatagaagttctacaacaattcaaggaactatgctaaactatatttctgaggcaattagtaacgtggtaaaagaaatatagtgtagggagaatcattaacattcccaaacatagagagttagcctcacatacctcaatttatccccttagtgatactacaatgatccacaacactaagaaccttcaatctataatagaacatccaatggaaccaatattagtaacaaattccataatttaagccatttaggcatattatcaaacaccttgtaggcataaatctctacatctcatcaccataaagttagttcatctaattaccaccattcatcgataatttatcccatcatcatgattaaccaatttataacttccaacatcacatatatgaccatccatccacatccaaccaataaaattccaacaaatattcatctttcaatctctactatagttatgtaattaaattgggaacttatggcttccaatcaccataacaagagttctattacttattcatacacatatttccttaataaatccatacatgtaagtcaaagggtgtaggattacttttttataagaaatcgtgtaaaaccctcctttgagtttttgaagaaatttcttgaagatctaagtattttatgtgtacatttcatcaatactagtgtagaaatgatagaattcacaccaagataatgggtattgcttaccttgaagatgggaggggttggaggccttgagagagtagaggaaaatcctaaacgtcgtccaaaagaaatgggggaaaatgaatcctgaaattgtgtttttaagcccagatttcggacgcgaaagtggatgctttgcatccgagtagtcctccgctcaggagctcggatgctacgtggatactatggcagcacttcactgccagcccctctttttggacgcagcctcggatgtttcgcatccacatagtcctccgccagcctttggtaatttgatcataacattttgtaggaaagtccaaattacaaacggtttgatgatttagaaaatagactcgaagatctttcatttgataggttttacatcacataaaaccttacatatgtgtagttatgctcatctaaagtgtggtcttgtacttacccatttggaattttaggctttcatgtagttttcaaacttggcttagacttaggtctctctttggacgccaaatcacttatgatatacctcatacacttattatcatatacaattgataaccgttatataaatagttcttgtccgcacacatctgattcatatttacggagtgttacattacccatactcatcctgatagggcttcacatgtctaaaagatcacattaatactcatctaacacatccacaactaatccggatttaaggggtgttacattatctcccccttgggattatttgtcctcgaatgattattttggttgtatcttaggctaacttcggaccttaaattggtttgtgggaacatgaactttcattaacacttccataataaactgaatgaatacacgattactgaactgatgagatactaaactggataggtactagagtgaatggctactaaattggctaaacactaaaagacatggagattgtattataaggtctgaatgagaaggttagatactttcgacatttctcccaaatacctaccagctaacagagcataacactagctccatagagcataataatacgcataacatgatacatatacatgaatacttatttgtcataggtacgtgaattctgaactaacctggatatataaaaactgaactggcacgaattatcgaggattgaactaacgtgaatatctgctcactgaactcacatcaatacctgagtattaagctgtcataaatatctgagtactggactggcatgagtatctgagtactaaactgacttgaatgttctaacatgagatctgaatactaaaaacataaatttcatgacatgagatttgaaaactggaaacaccaatgtcatgacatgagatttgaaaactggaaacaccaatatcgtgacatgagatttgaatactggaaacttgaatattataacataacacatgaaatactggtgcacaaccgctaattattgtggaaattctaactcataagctacttacccaatcctttataggatcctatatgagctgatgtatctgggattgagctttcctttcttcccaaatcttataacacctttcataagtgaaactttttgaaatacccaatcatcaacttgaaactctaggtctctatgttgcatgttcaaataggaattttggcaactctaagctgtctacaaatgatcttgaatcaacttgactttctccatagaccgattgaccaaatctggtcccaacaactccacttcgccaacttcgaaccaactaattggcaatctacaccttcgcccataaaaatcatgctttcaaaatgagcgagataatcctattatcaggtccatatttaccatctccactaaaggatgtgtgtgttctgagataaacacttggttttctgctgttcgactttcacttactgacaattcagacacttgtccacaaagtctgcaagtctcttttcatgtcgttccaccactaaatctccttaagatcatgatacatctttgggaaacttaggtggatagaatactcgaaattatgggcttataatatcttcctccctcacttagtccatctatggttggaacacacaatctatcctggtacctcaaagtacaatcatctcccccttgttcaaaagccattatcttatgcatgtgaatccctatttcagctacaacaagtagggatcatcaaactgtttctccttcactttggctactaaggaggaacaggtcgtgttctagacaacaactccactatctttggtgtccaaaagtcgaactcctaccttggctaagcagtgaacttctttcaacatagttctcttgtctacctaattcatgagctatacttcccacacttgattatcttcttaagcacttcttaaaaacacttatagtattattgtgaactagtctttgacatgtactctaaatttttgagtcccgtgcaatgacactaccctcataaataggcatgactttatagcttttctgtgattactttatcatcaataactaagctcggtgatcattctactcactttgtattttttttacacatgttagacatcttgtggtaattatacaatttttcctcattaccgatctgatttcctttttcatatccatgctaactctttgggtttcaaatcgctaactggactaactaatatttttcacttcaccctttagaccaaaggtcttatacatgcggatccttctatatttgttaggatcctaataaccttccttattttctgcaattctttgcactctacatcaatgacgactcatctcccaacttacttctgagctaggaaaaactaaattattcacataatggaaagctgatgttttcacacatatcatacacaatttaagccatttaggcatattatcaaacaccttgtaggcataaatctttacatctcatcaccatatagttagttcatctaattaccaccattcattaacaatttatcccatcatcatgattaaccaatttataacttccaacatcacacatatgaccatccatccacacccaaccaataaaattccaacaaatattcatctttcaatctctattatagttatgtaattaaattgggaacttatggcttccaatcaccataacaagagttctattacttatttatactcatattcccttaataaatccatatatataagtctaagggtgtaggattaccttttttggaagaaatcttgtaaaactctcctttgagttcttaaaaaaatttcttgaagatctaagtattttatgtgtagatttcatcaatactagtgtagaaatgatgaaattcacacaaagataatgggtatttcttaccttgaatatgggaggggttggaggtcttgagagagtggaggaaaaccctaaaagtcgtccaaaagaaatgggggaaaatgaatcccgaaattgtgtttataagcccatatttcagacgcgaacgtggatgcttcgcatccgagtagtcctccgctcaagagctcggatgcgacgcggatgctatggcagcacttcactaccatcccctcttttcggatgcagcctcggatgcttcgcatctgcgcagtcctccgccagcctttggtaatttggtcataacttcttgtaggaaagtctaattgatgaacgatttgaagatttagaaactgcactcgaagatatttcatttgataggtttttcataacataacaccttatatatttgtagttattctcatccaaaatgtggtcttgtgcttacccatttgaaattttaatctttcatgtagttttcaaacttggcttagacttaggtctctccttggaccccaaatcacttatgatataccccgtacacttattatcatatacaattgataaccatcatataattagtcctcgtccgcacacagctgaatcatatttacggagtgttacattacccatactcatcctgatagggcttcgcatgtctaaaagatcacattaatactcatataacacatccacaactaatccagatttacgaggtgttatagatactgcttttacctaagatggtcgggatcgaatccatagggggctagatttattgggaattggattcctatctaaactagaaatgcatagtgcccttaattacacttccaatcataattgttgtttattacttctaattttatactattgagatgctaaattaaacttagagtaattgcttgtaaggttttctaaatagttaaagaggcactagggaagtgactttctcctaggtgaatacttgacgggatctaaagcctaaggcaaagttgttatgttggggattgtgatatagccaatgcactgaactactcactctatacctctcggtagcatgagtgactttacctaattgactttctcaagactaattgggtgacaaaattgtgcaagcaatataggctcaagtcgggtattactatttttatgtttaaccctttaattggggctatcaatctcttgattacacccaattccttgttggactgattttcctagactcaagctctctttctcaagaagaacccaagtcaaataggcacaaattagtatttgcaaccaccaattcaacacggaaaacacaaatcagtccaaatatcaactgcccatacacatctaagccttagaacaatagacccatcaaatacccacactagggttgagccacaaccctagctaatggatctagctactcataataatggaataaaacagataaatagatgaaaaataacctatataatttgattacaaactaagaaattgaagatacaatattaaactagctacaaatgactcaaaatggaacaaaatcgtcgttcacatgctctggattctaactgacaccctaaaaatgtgaaagaaagtatttacactaggccgaattttctggacaaaaatacccctgatggaggtattgcggaccgcggaaaatgcaccgcggccgcgataaggctttttagctaaaatgctcagtatctgaatatggccaccgcggactgcataaaatgcactgcagctgcagtggattcactgcggtccgcacaaaatagaccacggaccgcattggcttctaatcttcaaactctcaactctctgaatcccttatctgcggatcacataaaatggattgcagccgtgaagaggcttatgcgaccgtgagaaatcctccacggacggcattgctttaagctccaaaagtgcccctttctgaactcatccactgcggaccgcactaaatggtctgcggccgcggggagtcctttatggatgcagtagattttatgctgcaatagtgccttgacttgttcttggtacttgtgcaggtttcactcctttttgagctggttttgactacttgtcacttttttgaccaaacactgcaaacaagtacaacatgtaagtctttgggatatttgtatacatttttaatcaaaaactcaagtaaaaagaagtgtaaaatgaactagaatccctagttatcagttctcaatcccaaaatccttctaacaaatctgaatttcaactatgaaagagtactacaaaaaaaacctaaacgtacttatgagattgaagattacattttcttagtatctcccacggatatggatgagccaaagcctgtgaataaggctttatttagctctggaaaagatgagtgtatgaaagcaatgaaagaagaagtagagtccatgaaaaccaataaagtctgggatctagttaagcttccgcttaggcatagagccattttgaacaaatgggttctcaaagttaaatgcaaagcggatgggtcaatagaaagatataaggcacggttggtagcaaaaggctttactcaagaagatagaatagattatgaggaaacatttcaccagctgtgaagtttacctcaatttgcttacttttggctattgttgcacgtttggatttggaattacatcaaatggatgtgaagacatcttatctcaatggagaactaaacgaagaaatctacatggaaaacttgtaggctttatcgttaaaggccaagaaaagaaggtctgtaaattgaaaagatctatttatggcctgaagcaaccttcaaggcaatggtatttgagatttctcatggagatgatctcgtataatttcaccatgatcaatgaagatcattgcatttatgtgaagaagtccaataggctatttgtaattcttttacgtggacgatatattactggccgaaaacaatttggagtatttgaaaactatcaagtcagggctttcaaagtcttttgacatgaaagatatgggcgaggtaggctatatccttggagttaagatccaaagagaccattctaaaaagttattgagtctatcttaagaaacttatataaataaaatcttggagcattttcgcatgaatagttgcaaatccatggatactcctatagcgagaggtgaaactttaaaccttgaaatgtgtcccaagactgaaaatgaaaaggaagacatgtcttgagttccatattcaagtgttgtcgggagcttgatgtactctatgatgtgtactcgcccagacatttgttatatcataggtctggttagtaggtatcaatccaatcctggaagagatcattggaaagctgtgaagagagttttcagatgcctgaagggaactgcagattattcactatgttattatggaaataatttatacttgagaggatatacagatgctgattgggctggtgatcgaaatgatagaaaatcaacatccggttttgccttcttacttaatggtggtgctatatcatggaaaagtaagaaacaaacctgcacagccctttcaacaatggaagctgagttcgtggcttgtgcgtctgcagtataagaagttgtttggttgaagagattctttgagcatttaaatattacaaagaactctcaggttcccatggctctatattgtgatagtcaagcagctattgcatatacaaaagatcctaagtatcatagcaagatcaaacacattgacatcaagtataactttgtgagagacatggtagcaagtggatggataaattaacagtacatttctacgcaaatcatgatagctaatccttttacaaaggcaatatctagttgggaaatatgttatgactctaggtttgcgaaggatataaatatatttatgtattttaaaatgactttttttattataatatactcatcaatatttgactcttgactttatgcttatatcttgtatgcatgtgatgatgttttgttgataaagtgcgttgaacaagttgcgagattgtctctctcacactagcaatcacctcttacgttaagaatcgtgaagatacgagaccttatagaaccttggataatacgaggttatatttacttgtaaaggtcagtcttgacaactagtcaaacttatgaattttaccattcgcgtatgacttgttttgtatgtcagatgccagtttctcaaaaaggttgtatttgaggattattaaagtgagaaactcagattagatatttgaaggtgtctagaccaagatctgtacggtgttgaatgattaatagaataagtcacacgcactaatacatgatgagaacaccgtaacacctgtttcataccacgtgtgttaacgccactgggatgatgaaagaatgaatccatgcttcttcattgtgtgagatgccaaagaagttatattaacttttattggaataccctttgaccttttattgtctcttgaagtgccaatcaatgttgctacgttagcatgtcactaatagtcatgaatgattcggcaatgcagtgcatgtctaggaaaacaattgatttggaatagaaagattagagtagaaagggaaggcaactaaaaaaatgtagtaaattaacttgtatgaatatgttgaccattacacttaccatgagggtatcaaatgtaattatgaatacaaagtgaaacatgaactcgagttcacctgtttcaaggatgagggatcaaataactaactatttgagtagcaggtgatgtctggggtatagcgagtaataagatccccatgttagtagtgattcctttccgaatgtgatcgaatgtctacatagagtttagaataaccttaataagtttgaaatatattatagctcttgatgctcgcaggttgcacaaactacttgtctgtatgaattaagtgtattatttattcatgatactggtttgagtctagcccatcacgagtgaagtgggagatattggatttcttggttttgggtcgctccatgtgggctgacccaacctatgtaaaagagataagggagttatctataaagaagttactgcacaataaaaggggagaaaaatatagaaaagtggaaagttggttttttagaagaaaatcgtatcttttcttttttaaaaggaaaagtttgcatacgctttcaaatacaactccaagagacagaaaaacttcctcttgaattctccaataaacacacacaaaatctagaatatttagttcgtggataaaactccatttccaagagattcagagtacgacttggggctattattttggtggtgagttcaataactcttcagctgcatcattgacatgtacgctattattgctctctccccgggaattattctaacaatgtatgagaaaaatctgtgttttttgaagcttgttctctatccaaaaattataaatgaagagctaagtttttttaggaaaaaattacgtataacaaataatgaaatttgttattcttttcaattagacaagtcaatttgaaaattttatgtaacaaattgtaactagtcacatgtaacaaaatattaataggcaaataaccagttatatgtgttggatattggatttgggtcgcgggtcgcccatatggactgaccctacccatttaaaggagataaaacctacataggttgcctaaggaggttaaaataaagataaattaaaataaaaaactgttgcacgttagagatagaaggggaacgtgggattgaatatgagcgggcagttttttcctctcttgaaatcctctctctcctttatatatatatatatcttcttcaatagagaaagatagaagtcctgaagtaattctccctcaagaaaacacactctgaaaaaggtatttagatagtgaacaataactttgtttcctgaaaattcagaatacgatttggggaaattcctttggtggtgagttcaacagcttccgttgcgtcaataaggtacacaacttgttgttctcgccccgcgattattaatcaacaatggaatcaaagcctggtagtttgatcctaattgctgccaccatgattgtcacgaccccggttcgccctccgtgaaccatcgtgacggtacctagtctctacgactaggtaagcctaaaatgtggaagataaaccaaatttgcgaaagaaaacaatttataataggaatagagtaataaaacaacgtttacaagtgtcactcggcatacacaatattaactcttaaaacccatacatttttttccaaaatccgaaaacccatgaatcacaagctacgaatataataaaaatgctctaactccggaatgtctacatcaatggaagaaaatagaagggctatcactacaagatagaatggaaaggtactcctcagtttgcggacgcatcagatatacctcgaaatctttggagcagtcgcctcgcctcaagggtgataggactgagtcaaagtacctggatctagacatgaaaaatatgcgcagaaaaggcatgagtacaccatagtggtactcagtaagtgccaaccctaacctcggtcgagtagtgacgaggaaggtcttggccctactgaagttaaataaaataaaaatttcgatagtgtagaatagaacagtataaataggtaaagcagtaaaagtaacacaagataaaaaggcacaacaactattacagagtcaaggtaaacacagaaagaaatatggctcggcaccaaaataacaatcggggatctcccaggataccgtcctgtagtcccaaatatacatatccaatggatctctcgggatctcgtcccgtagtccaactcatagtgcgcggggaatctaccgcaattccattccgtagtcccaaatataaatacccagtaccgggggactctactgggtgcagtcccgtagttccatataactgtgcagggggatctaccggaatctcacatctatagtcccaaataaacagacaagggggatctaccggaatcctacatccgtagtcccaatgtaaatacatagcaacaacaggaaaatattcagcaaatgtcaattccatattaaggcaaacaagtaattctagtctagcatgctgcacagaattcaggtagagcagcttgagcaaataaagcaatcaaatcacttagacattctttcctacactaacaacaagcttatagtacaagtaatataaacaaggaaggaaatacactagtaattatttaatgaaaatcggattttaaacaattagcacaagtacgcactcgtcacctcacgtacaaggcatttcaattaacaataatactaaatcctaaggggaaggtcccctacacaaggttaggcaagccacttacctcgaaccggctcaaaatcaactcgaaaccacgttctttccatgagtactcgactccaaatggcccaaatctattcaatccaattgtataatgtaaataacacttcatgtaactgattctacaattaaattctaagctaatacacgaaattaggtaacatgaccaaaatgcccctcgggcccacatcttagaatcgggtaacatttatattttcagaattctcatactctcacgagttcatgcataccaaaattatccaaattcccaatcaaaattcgaattctaggtctaagaactttcttccaacttttccccaattttcatctgcaatccaaaattaaatgatgaaactaagtataaattaatggaatataactagatagggttaaagagtttttacccaatgctttactcttcaatttcctcccaaaattgccctctcccgagctccactttgatttttccaagttttgaaccaaaccctcgaaatttcatatttctgcccagcgattactgcatctgcggtcaagggagcgcacatgcagtcccgcacctatggaagaatgcatcgcaggtgcaaaaagtcacttaacgggctgggtccgcaactacggtcgcttggccgcatctgcagtatctctgcaaaaacctagccgcacttgtggatcctagagcttggtccaaatctcgctcctgtggcgccgcacctgcggtcccacactcgtaggagcggttatgacaggaaaccaacagctgaagctgctcaaacaaattccaatttcttccgacaaccttccgaaaccatctcgaggcccccgggacctcaaccaaaggactaacaagtctaataccactgcccaaacttgtactaatccttaaaacacctaaaacaacatcgaaacgatgaatcaatcgcgaattcaagcctaagaactccaaaactctaaaaatgtgctttcgatcaaaaagtctatcaaaccttgtccgaatgacctgaaattttgcacacacaacacattggatcaaaatctcactatcgaaccggaaactttaaaaaatcaactttcagcatttcgaacctacattagctacggacctccaaagcacaatccgatcacgctcctaaacccaaaatctcctaacggagctaatggaaccatcagaattccatttcaaggtcgtcttcacactgttctgactacggtcaaatttccaacacttaagctctcatttagggactaagtatccaaaaaatctccgaaactcaaaatcgaacttcccggtaaattaaaatagtagaaataaacacgagaaaatttgttaattggggatcggggcgtaaatttataagacgactggccgggtcgtcatatcctcctacacttaaacatctgttcgtcctcgaacaagcataaagacatacctgaagtagtgaaaagatgagggtaacggctgcgcatatcttgcttggtctcccaggtcgcctcctcgaccggctgaccccgccactgaaccttcactgatgcaatgtcctttgacctcagctttctaatatgcctatccaatattgccactgactcctcaacataggatagatccttgtccaactggactgaactgaagtctaacacgtgcgatggatcgtcgtgatacctccggagcatcgaaacatgaaacactggatgaactccttccaagctgggaggtaaggcaagctcataagcaacctccccaacacacctcaatatctcaaaagggccaataaacctcggacttaacttccctttcttaccaaatctcataacgcccttcataaccgaaacccgaagcagaaccctctctccaaccatataggaaacatcatgaaccttccggtctgtgtagctcttctgtctgggctgtacggagtcttcataggggctgcaattgatgaaaaccccttaacaaaacgactgtagtaacccgccaagccaagaaaactgcgaatctctatagctaaggatggtttgggacaactctgcatggcctctattttcttcggatccacctgaataccctcactcgacaccacgtggcctaagaataccacaaaatcgaaccaaaactcacatttcgagaacttagcatataacttcttttctctcaaggtctgaagcactgtcctcaggtggtgctcatgatcttcctgacaatacaccagaatatcatcaataaagacaatgatgaacaagtcaagatacggctggaacacactgttcatcaagtgcataaaagttgttggggcattggtcagcccaaatgacataacaaggtacttgtaatgaccataccgagtcctgaaagcagtcttcgggatatctggctcccgaatcttcaattgatggtaacctgagtgcaagtcaatcttagaaaacacccgtgcactttgaagctggtcaaacaaatcatcaatacgaggaaaaggataacggttcttcactgtaaccttgttcaactggcgataatcaattcacatacgcatagaacaatcctttttcttcacaaacaagacaggagcaccccaaggtgatatattgggccaaataaaacccttatcaagcaaatcatataactgatcctttaactccttcaactaaggaggagccatatgatatggaggaatagaaataggctgagtgcacggcaacagatcaatgccaaaatcaatatctctatccgagtggcatacccagaagattagctggaaacacatcgggaaaatatcgtactattggtactgaatcaactgaaggggtatccatactgacatctctcacataagctaaatacgtgtcacagcccttctcaaccatacgctgagctttaagaaaggaaataactctactgggagtgtgatctaaagtacccctccactcaacacgtggtacacctggtatagccagcgtcacgattttggtgtgacaataaagaatagcataatggggagacaaccagtccatgcccaagataatatcaaaatctaccatgctgagcaagaataaaccggctctagtctcaaaaccaaaagcaaccaaatacggtcgataaatgcagtccacaataagagaatctcccataggagtagaaacataaacagggaaactgaaaaaatcccaaggtacacccaaatttggagcaaaataagaagacacataagaataagtggagcctggatcgaataaaactgatgcatctctgtgacaaaccagtataatacctgtgatgacagaatcagaggcaacaacctcggtatgggcaggaagggcaaaatatctagcctggcctccccttctagagagacttctacctccccgacctccacctctagctggctgagcaggtgggtagcaactggagctgtaatcatagcctgagaactctgcagggcacaatgtggctgagaagtctgtggaggtgcacccctccaaagtctggggaaatccctcaccatttggtgtgtcaccacactcaaaacaagctctgggaggccgtgactggctcgggccaggtctcctggactgacctctgaaagcacctcgtacaggaggcgcgctagaaaccggatgtgcataataaggctcctaaggcctaggatgagctggaataccattggctactggaaaagctgaatgaacagggcgactcatataacccctaccatggcgatctacagctggggcacgagcaccaggataatggcccgactctcgagacctcttggcctccctctcctctctcttcctagcatgcataccctcaatcctcctagcaatgctcaccacttgctgataagaaatatccatcttcaactcacgagccatgctagacctgatgttgggaataaggccctcaataaaccagcgaaccctctcgcgaacagtagaaaccaaggctggtctagctaaactaatgtaacggatagcatactctgagacagtcatagaaccctagcgcaaatgctcaaaatctgcgcgccatgcgtccctgaggctctgaggagcatactctctcaggaacagatctgaaaattgagtccaagtcagtgaagcagcctcatccggactgtctaactcataggtgtgccaccactcataggcggctcctcgatgttggaaagtagtgaaggaaactgcgctcgatcctgatatacccatggtacggagaataaggcaacactcatctagaaatttcagagcatcatccgatgctagactatagaatacaggaggcttgtacttcttgaacctctcaagccttaactactcatcctcggaaaccactgccctatccttggcatggtcttggactgcaggctatataggaataatatcaaggaccttctcaacatgcactcgctgcttaggagtacgggcggcgggagtctgtgctcctcccccggcctgagacgtagctgcagcaaggggaagcaactctgcctgagccaaagtggtgtaaatgctcatgaactataccagagtctcctgaagggctggagtagtagtagcagtaggcgtatcaggcgcctggactccggctggaactgctggaggtacctcggtggcagctcgtgcaggtgctctcactgcaccacgtgcacgtcctcagcctctaccccggccccagcctctaacggtagcagtagggggcgcgggtgcctgatcatctcgggtagcgcgtgtcctcaccatctgtaagggaatagaaaacaaaagcttataattgtcacatcaaatcttgtacgatacggaaatcaaatgaaatggaaattttcctaacggttacatagcctttcgtagataagtacagacgcttctgtactgatcagtaagactctaataaaccggcttgtgattcatgactcctatgaacctagagctctgataccaacttgttacgaccctggttcaccttccttgaaccatcatgacggcacctagtctctacaactagataagcctaaaatgcggaagataaaccaaatttgcggaagaaaataatttaaaatgggaatagagtaataaaacagcgtttaaaagagccactcggcatacacaatattaactcttaaaaccaatacatttttcccaaaacccggaaacccatgaatcacaagctacgaatataataaaaatgctctaactctggaatgtctacatcaacagaagaaaatagaaggggtatcactacaagatagaatggaaagggactccacggtctgcggacacggcagatatacctcaaagtctctggagcagtcgcctcgcctcaagggtgataggactgagtcaaagtacctcgatctgcacatgaaaaacatgtgcagaaagggcatgagtacaccacagtggtactcagtaagtgccaagcctaacctcggtcgggtagttacgaggaaggtcagagccctactgaggttaaataaaatataaagttcgacagtgtagaacagaacaatataaataggtacaacagtaaaagtgacacaagataaaaagggcaacaacaactattacacagacaaggtaaacacagaaagaaatacggctcaataccaaaataacaattggggatctcccaggataccgtcctgtagtcccaaatatacatatctaatggatctcccgggattccgtcctgtagtccaactcatagtgcgtcgggaatctaccagaatctcgttccgtagtcccaaatataaatacccagtactgggaaaatctaccgggtgcagtcccgtagttccatataactgtgcagggggatctaccggaatcccacatccgtagtcctaaataaatagacaagggggatctaccggaatcccacatctgtagtcccaatgtaaatacacagcagcaacaggaaaatattcagcaaatgtcaattccaatataaggcaaacaagtaattctagtctagcatgctgcacagaattcaggtagagctgtttgagcaaataaaacaattaaatcacttagacatgctttcctacgctaacaacatgcttaaagtgcaagtaacagggaaggaaacacactagtaattacttaatgaaaatatgattttcaacaattagcacaagtacgcactcgtcacctcacgtacaaggcatttcaattaaaaataataccaaatcctaagggaaaggtcccccacacaaggttagggaagccacttacctcgaaccggctcaaaatcaactcgaaaccacgttcttgccatgagtactcgactccaaatgacccaaatctattcaatccaattgcataatgtaaataacacttcaagtaactaattctacaattaaattctaagctaatacgcgaaattaggtaacatgaccaaaatgtccctcgggcccacgtctcggaatcgggtaacatttatattttcagaatccttatactctcacgagttcatccataccaaaattatccaaatctaaggtcaaattcccaatcaaaattagaattctaggtctaagaactttcttccaacttttccccaatttttatctccaatccgaaattaaatgatgaaactaagtatagattgatggaatataactagaaagcgttaaataattgttaaccaatgatttcctcttcaatttcctcccaaaatcgccctctcccgagctccactttgattttttcaaattttgaaccaaaccctcaaaatttcatttttttgccagtgattaccgcatctggagtcaagggagcgcacctgcggtcccgcacctgcggaaaaatgcatcgcaggtgcgaaaattcacttaacgggctaggtccgcatctgcggtcgcttggccgcatctgcaaaaactcagccgcacatgcggatcctggagcttgggccaaatctcgctcctgcggtatataacctcttctatggtgccgcacctgcggtcccacactcgcaggtgtcgttatgacaggaaaccagcagctgaacctgctcaaacaaattccaaattcttccgacaaccttccgaaaccatctcgaggcccccaggacctcaaccaaaggcaccaacaagtttaatatcactgcccaaacttgtaccaatcattaaaacacctaaaacaatatcgaaactacaaatcaactgtgaactcaggcctaagaactccaaaactctaaaaatgtgctttcgatcaaaaggtctatcaaacctcgtccgaatgacctgaaattttgtacacacatcacattcaacactacggagctactcaaacttcaggaatttcattccgaccctcaaatcgaagtcccactatcaaaccggaaacttcaaaaattcaactgtcggcatttcgagcctaaaattagttacggacctccaaaatataatccgatcacgctcctaaacccgcaatcgcccaacggagctaacagaaccattggaatttcattccgataccgtcttcacactgttccgactacgctcaaatttccaacacttaagctcttatttagggactaagtgtcccaaaactctccgaaactcaaaatcgaacatcttggcaaattaaaatagtaaaaataaatacggacaaaataattaataggtgatcgaggcataatttcttaagacgaccggtcatagtaatatgtacttcgataccgataatcgttgtttgaataaggcatttttttttgtgtgccgtaaaacattttttttctgtttttttttcatccgctatcaacagaagatgatctatcaaaagtacaatcagtgtctgtctcattaaaacaaggacaactttttaagaaagagaaatagacttttgtaaaaagcttgaacatgctttcagccaagaaagaaacaacacaaaaaggaaaagaatttttttttacactggctctttgatattattggctctacatcaacgacaaataaaaagtcccaatgttgtcttctgaatgccattattattgtcttctaaatgcctacatgattttccttgaaaatatcagtgtaataatttcctcgattaccataacatataaaaaaaatcatagatgttttgttcaagacaatgacccttgaatattttatttaatggtactgcctctttcttagaatttccccacttaatcaataatgtttctccttttataatgcatgtatggcagtcgaaataagtgacagagattttgtttgtttacaacaaaataattatggtttgttagagatcttctgtacttaatggaatattgtgtggcttcagtatcataatgagtcacttcttgaagacttgcaccctatattctaagaaagaaacattgtctgtttcagtgaattaaaattagtttagtcctgatccctcaattaatattattctataagtaattgtgatatatgttgttacattgaatggttggagtcattcttattatttccttggtcctatttcagatatggctgaacagggacaagttcgaattatttcaattgggagttctcgaagtccaggaagggaacgtcgtcgcaggacttatttctataatgattcagactcggagcctgaagtcatcaagaatatcccaagggcgagacaaaatgcgttaagggattgaagggctgaacgaagggaaagagaaaagaaatttagggagtttaaggaatttaatttttttctgatgtttccgttcctgaaaatatacacctttttaagataaaaagagttgaattggctaattacgtagaaattactgattgaaaagcattaactattttagtgaactctcttcgagagccttggggtgaaattttaactgagatttattatgatgtttggcctagtgcaccttttagcgtaagagttagtgttcgattggtatatggatatcctagcaaacatgtaaattgttattatgagttttattttaatgaaatttatattatgttatttgtcgcactagttacatacattgtttattatatctttttgtaatggattgagacttaaaatatatacacactataaagtgattttaatattaattaaaaatatttagatatagatgatgaatggaaacgtagtgaccgttcgattctatactaaatgtagaattaatattataattaatttttttgagtgtgtaataacatgcatatattaactgaagtatatattgatgagttaaacttgtaatattgtctttaataaaagacatggcatcaaaaagtatcattgctaacttgaacaagggtgacaaactgaatgatgaaaattacgatatctggagtcgtaagatgtggtatgtacttgaagagcaagatgatcttgaaagtattaaccatgtaatgagtcacccagaggagggtaacactgcccaacataggagggatttggaaacttacaatatttggaaaaagaaagattctactgcacgtggaatcattgtaagttcagttgttgatgatctcatctatgaatgtgagcaatatcctactgctcaagccatgtgggcacatttaagggaggcatatgggggtacgactgtgactcgcctttgacagctaataatcaagtttgacacgtacaaaaaacgtcatgatcacggtgtcaagcaacatctaagggtgatgtcaaatatgattgctcaactcaaaagtgttggccatttctctctgatgagcagcaggttcaagcagtgattcggtctcttcccaataattgggaacatttgaaggttaacttgactcacaatgatagcatcaaaacttttgtgatgttgcccgtcatgtggagcttgaagacgagcggcttggtgctgctaaagctgtacctattgccttgtggaagtatcaagttgtacaaagagatcaagcttcaagcgcaagagaaactgaaaaaatgacggaaagggtaaggagaccggagaaggaccctccaagaaaagaaacaagccaaattccaagaaaggagaacgattctacaagaagaaagacaagagcaagatgaagtgttacaattgccaagttctagggcattttgctcgtgagtgcacttagccgaaaaaggtagcatttcaaaacgcatctcttagtgctatatatgtttctaagactgttttactaactgcatcttatctcatgtggattgtagactcaggggccaccgaccatgtgagccgcgatagagaagtgtttatagagtttcgtcgagttccacatggatcaaggcatgtatatgtgagaaataattctaagcttgaagtcaaagggatacgaacttgcagaatggacatgcgtggtggccgatctttgatgttgcatgacgtcctatatgttccaaagattcaacgaaacttagtatatgtgtctgttcttctagatttagatttcaatttgaactttagtcgtagtggtcttagaattactcaagacaatgtttttcatggttttggacatcgttatgatggttttactatgttagattgtaatccttctacgtataactattatgttgaccgttgtgttatggcatgttattctagcaacaataatgttgatgttattacatggcatgcaagattaggtcacataggggaggatcgaatgaatagattggctaaggaaggacatctaggtcctttctctaaaattgaaatgccaacttttgaaaattatcttgcgggaaagattacacgtaaaccatttggaaaggctaaaagagctcattttccattgcaattaatccattatgatatctgtggtccaatgaatgtgagggctaggtctggtgctttattttcattacgttcattgatgattctacactctttggttatgtctatttgatttttcataaatctgaagtacttgaatgctttaagaaatatttcagtgaagttgagaatcaattagacaaaaggattaaaaccttaagaaccgataaacggcgtgaatatctttcaaaagaatttgaagaattgtaaaatgaaaagggaatcaccatacagttgactattccgtacacacctcaacaaaatggtgtagcgaaaaggaggaatagaacactattggacatgataaggtccatgatagcgtaggcaaatttacctatctccttttggggagatgcgttattgactgcaacatacatattgaacaaagtgacttctaaatcagtttcttccacttcctataagctatggactagtcataaaccaaacttaaaggatttacaactttggggttgtgctacatatataaaagattcttttagcaagtttggtaaattaggtccaacgggcaagaaatgtatctttataagatattcagaacactacaaaggttatatgttcattggtgaattagaggatggaagtgttagtgagattgaatcacgagatgtcacatttctggaaaatgattttccaaagaagggcgaggtaaagaatagtgagcctctttatgaaatgttgaactcagatagtcagcaagtgtcttctgacatagttgataatcaaattgatcaagatcttattcttgatccgagtgggagtgggaactctcaatcccaaaatccttctgacgaacctgaatttcaactacgaaagagtgccaggaaaaatatacccaaacgtacttatgaaattgaggattatattttcttgatatcttccacaaaaatggatgagccaaagtctgtgactgaggcttaatcaatccctggaaaggatgagtggatgagcaatgaaagacgaattagagtccatgaaaaccaacaaagtttgggatctagttgaccttccacttgggcatagagccattggaaacaaatgggttctcaaagttaaacacaaagcagatgtgtcaattgaaagatacaaggcacgattggtgtcaaaaggctttactcaagaagctggaatggattatgaggaaatattttcaccagttgtgaagtttacctcaattcgcttacttttggctattgttgcacgtttggatttgtaattacatcaaatagacgtgaagatagattttttcaatggagaactgaacgaagaaatctacatagaacaacctgtaggcttcatcgttaaaggccaagaaaagaaggtctgtaaattgaaaagatctatttatagtctgaagcaatcttcaagacaatgatatttgagatttcacaaggaggtgatctcatatgatttcactgtgatcaatgaagaccatttcatttatgtgaagaagtccaatgggatgtttgcaattctttctctttatgtgaatgctattttattggccggaaacaatttggagtatttgaaaactatcaagtcagggctttcaaagtcttttgacatgaaagatatgggcgaggcaggctatatccttggagttaagatccaaagagaccgttctaaaaagttattgagtctatcttaagaaacttatataaaaaaaatcttggagcattttcgcatgaatagttgcaaatccatggatactcctatagcgagaggtgaaactttaagccttgaaatgtgtcccaagacagaaaataaaaaggaagacatgtcttgagttccatattcaagtgttgttgggagcttgatgtacgcaatgatgtgtactcgcccagacatttgttatgtcgtaggtctagttagcaggtatcaatccaatcctggaagagatcattggaaagttatgaagagagttttcagatgcctgaagggaactgcagattagtcactatgttattgtggaaatgatttatacttgagaggatatatagatactgattaggctagtggttgaaatgatagaaaatcaacatctggttatgcattcttacttaatggtggtgctatatcatggaaaagtaagaaacaaacctgcacagccctttcaacaatggaagctgagttcgtggcttgtgcgtctgcagtataagaagttgtttggttgaagagattctttgagcatttaaatattacaaagaactctcgggttctcatggctctatattgtgatagtcaagcaactattgcatataccaaagatccgaagtatcacaacaagaccaaatacattgacatcaagtataactttgtaagagacatggtagcaagtggacagataaatttacagtacattcctattgcatgatagttgatcctttaacaaaggcgatatctagagatctgtttgagaaacatgttatagctctaggtttgcgaaggatatgaacatatttatgtattgtaaaatgaatttagtattataatatgctcatcaatatttgacccttgaatttttcttatatctcgtatgtatgtgatgatgttttgttgataaagtgtgtcgaacaagtcgcgagattggctctctcatacgagcaatcgcctcttacgttaagaatcgtgaagacatgagaccttatggaaccttggaaaatgtgaggttatatttacttgtagagatcgatcttgacaactaatcagacttacaaatttgactattcgattatggcttgttttgtaagacatatggatgtttctctaagaagatggtttgaggattattgaagtgagaaacttgggttagacatttggaggtgtctagatcaagatctgtacggtgttgaacgattaaaagaattaggaacgcacgccaatataaggtgagaacactgtaacatgtatttcataccacgtgtgctatcgaccatgtgataatggaagaatgaatccctgcttcttcattgtgtgagatcccaaagaagttatatcaacttttattagaataccctttgaccttttactgtatcttaaagtgccaatcagtgttgctactttagcatgtcactaatatccatgagtgatgcggcaatgcaatgcatgtctaggaaagcagttgatttggaatggaaagattcgagtagaaagggaagacgactaaaattttgtaatttaacctgaattcataggtcgaccattacacttaccatgatggtatcaaatgtaattatgaatacaaagttaaacatgaactcgagttcacctctttcgaggatgagggatcgaataactagctactggagtagtgggtaatgtctggggtatagcgagtaataagatcctcatgttagtagtaaatccttttcgcatgtgattgcatttctacatagagctattaaacaaccttaaagggtataagaatattatagatcttaatgctcgtaggttgcacgatctatttactagtatgaattaagtgtgttatacacatggcactagtttgggtctagcccatcatgtgcgaagtgggagatgttggatattgggtttgagtcgcgggtcgcccatatggactgaccttacccatttaaagaagataaaacctaaagaggttacctagggaggtgaaaacacggataaattaaaataaaaaactgttgtacgttagagagagaaggggaacgtgggattgaatgtgagcgggcagttttttcctctcttgaaactcctctctctcctatatatatatatatatatatatatatatatatatatatatatctttcttcttcaacagagaaagatagaaggcctgaagtaattctccctcaagaaaacatactctgaaataggtatttagatcgtgaacaaaagctctatctcttggagattcagaatacgatttgggccaattcctttggtggtgagttcaacagtttccgctgcgttaataagaaatacaacttgttgttctcgccccgtgattattaatcaacaatatgtaacaaaataggtgacatattcaaattgaccgacttttgtttacatattcaaattgtaaatagttgcagcttagcatttcgacgatttaacttattgcattgtacgttattatacctctttcagagaataaaattgatatttatgattatacattatgatgaactccaaaaacttcgcaccaaaataattggacaagaaactcatgtgtgtacaatctatcctagaaagtgtatggtgtatgaatttatataagttttattcaaatgatgttaaaattagatttttagatcatttaaattgcaactgcaagtaggtttgaatattaaatatcaattaataaacctgaaaagatctaagatagaaaatctgttgaggtataatgagttacatatgctttataattacattatcgttccagcaaattagttggatcgtagctcatttattacccgaaattctcaaaacaaaaatataaacaacaaattaaacgccactacatttatatgtttccaattgtaaaattttcaaactggttaccttcaaaatcatgtttttggacaacattaaagctaaaataaaagctccattttataaaaaaatttgggctatgaaccattgatgtttagcttaaagcatatatatttctatgtatatcgcctcatattttacttttgtttcgtgaatttgggatgttaaatgctatcatttatattaatttgaagtgttttcatgtgtaggaataattcgggagcaattgggggcgaaacgcgcaaaattagagccaaaacgaacaaaaccaaaaaaattgtgcatttgggcgccacatgcagtgcctggcgccacccgtggcgttggaacaggagttgaaaattgggcagcgtcctggtgggagcccggcgcaatccagggcgctgctaacatgatttttgtcccattttgccagggacacggtttattcggctttagacctacccaacagtataaaagaaagactaagcctatttttgatgggagagacgcactttggaggaaaaatacacacaagaaacatccgggagcaagaacatctcagatttcttcatcttttctagtattttcaattattcaaaccttatgcaattgtttgctagtattatgagtggctaaacacccattgaaatgggtttgtgatttagccatgcatattgttgtttaacgttgacttaacctcgattataattcactaacatatggttgtttctttaattctgtgtttaactgcttaattgtctggctaacagttaggttctatttactatctatgctatgcttgggaaagccgtgtttatattagagaagaattgaagagagcatgatcttaacccttagggggagcggatttgtggttaggatagcaatatacctagtcaccgtacttaattaaatatcgtaatcttaatgcgttcttaatagactgatttcataggaatataggcgttaatctattttgaataggcgagtagtacttcgggagaaggttatgagagcaattatcgattaattagcaaccgtgagtgaattgtatgagagagagagagagagttaattagaacacaatacgaatggtgaatcgatcacaaccctggaatatttgtctctattgaatacataacaatcattctactgcttaataatttagttattacttagaattgtagtttagtataattaaaatcttgaactcgaatctagcttgactgaataacaatattggtgagttagtgagtagttgatataagtctctgtgggttcgacattcaacttattattttattacttgtacgaccacgtatacttgcgtgtgcgtttgggagcaaaacgtttttggcgccgttgacggggacttaaaaattagctactttgctgacttaagcttttattagttatttgttcaagttttaattgtcagtttaccttgtttgtgttaacagagactcttctcttgaatgcggagaagtagaagcgcaaacaatctccttcctcttgatcctgaaattgaacggacacttcacagattgaggagggaggtcgaagctagaactagaattgaaagagagtaggacatcgtagttcaaccacaaccaatcgagatggaaggtaatgcagagcgtgcagtaatagaagccgcaaggcccaatcttgctaatatgacttaagctattgtgaagcttgagatcccagggcattttcaactcaaatagtacatggtacaactgattcagtccacagggcaatatgtgggtctatctcatgaagatctgcagaggcacattcagaatttcttggaaattatggacacctacaattatccgaacgtttccaaggactatgtcaggccgacaatttttcccttttcactgctgggggaagctaaggaatggttacagaaagagcccatgaactaaatccacacttgggatgatctagcaaggaaattcttaatcaagtttttccccaccaagaagacaaaatcattgaggaatcagattcttgggttcaaacaacgggatggcgagacacttcgttaagcttgggaaagatacaagaagctactcagagattgcccgtaccattatcagactgatggggtattgggacacacttttgttggcgagatagatgaggcctcagagatgaatcttgattcagcttgtggggttagttgcatggcgaaaccatatagtgaaattctactcttgctgaataacttcactgctaatgatcataactggcaaggagatggggattcatgcaaggcaagtaaacagaaggcagtcgggttgattgagcttgatgacttctcggctatgagagctgagatagcaaaattggcaaaccagatgaatagaatgataatgcaacagacacaacaaattcaccatgtacaatagattctttgttgcgaactgtgtggtgaaaaccatatgagtgacatgtgccccacgaatccataatctatatactatatgggacaacagagcaatggtccaatgaatcagaatgcacaatatgggaacacttataaaccaaattggaagaatcatcccaacttctgatggggtggaaatcaaccgaatcagaatcattatataccccaaggaaatttcaatcagccttagaagccacctcaacaggcagaagagaaagggaatgatttgttgaagcggttgttgcttgacaatcaacagctcaggaccgatttcaaaaatttggagcgccaaatgggacagcttgccactcaaaaacactagaccagttggagctcttccaagtgatactgaagctaatcctaaggcatcccttaatgccatgccattgaggaatgggagacaattagaagaggtttagtcgagaaagagcaaacatgtgacttttgatgagaggcaagccactattgaatcaacatcaaaaaaatctaaggaatccgagaagccagctggagaggtggttgctgagcaatccccaccagtggttgcaaggccaccaccttcgttccctcaaagattgcagaaagtaaaagataacaccgcatataaaaagtttcttgatattttgaagcagttgcaaattaatattccgttggttgacatcttacaagaaacgcccaaatatgcaaagtacaataaggacatagtggcaaataaaacggggttgaccgagttcgaaactgtggcacttactaaggagtgtagctcaagaattcaaagcaagttacctcagaaattgaaggacccaggtagtttcactatccaaatactgattggtaaacatgcagttaggcgagccttatgtgatcttggagcgagcatcaatttaatgtcgctatcggtgttcaaacaattggggttgggtgagccacgcccaacaacggtaatcttacagctagctaatcactcccttgctcatcctgaaagagtgattgaagatgtgctggttcaagtagggtctttcatattccctgctgacttcattatcctggactacgagcccaatcaggaagtcccatttattttggggcatccattcttagccacgggccgagatattattgatgtttgcgaaggaaagatgacgatgagagtaggtgatcgagtggaggtattcaatgtttataaagtactcaggttgccaactcactatgaagagttatccatgatctctgtggtggagagtgatgccacattgttagtgccctatatgatccctgtagatcctgttgaacgagtgttgattggggatgacgaagatagtgaagatgaaatgatgggagaaattgagcaagtactggatatgtcctgcagttatatccaggggtttggaaaatttgaggagttggacaggcctgtcactctgacccctcctaagccatctattgaagaagctccgaagctagaacttaagccacttccagcgcatctgcgctatgcttagttggagaactctgagacattgcccgtgattatttcgtccagattgaccaacactcaagaagaaaaattgctcagagtactccgcgagcataaaaaagccattaggtggactattgctgacatcaagggaattagtccatcggtttacatgcatacaatctttttggaagatggacaccgccctagtgtggagtagcagagaaggttaaaccccattatgaaagaggtggtgaaaaaggaagttatcaagttgctcgatgcaggtatcatttttcctatttctaatagcaactaggtaagcccagttgaatgtgtgccaaaaaagggaggaatgactgtgattgagaatgagttaattcctactcgcactgtgacgaggtggagagtctacattgattatagacggctcaacaaagcaacccgcaaggaccatttcccacttccattcattgaccaaatgctagacagattagtcgagcatgaatattattgcttccttgatggttatttgggatacaatcagattgtcatatgcccagaggatcaggaaaagaccacttttacttgtccttatggtacttctgccttcaagcgaatgttgtttggtctttgtaatgcaccagccactttccagaggtgcatgatggctattttcaccgacatggtggaaaaattcgtggaagtggttatggatgattttcagtttttgggtcttcttatgatgattgcttgaggaatttaagcaaggagttgtcccattgtgaagaaacaaatctagtactaaattgggaaaagtgtcatttatagtacaaaaaggcatcgtgttgggtcacagaatatctaggggcggcattgaagttgataaggcgaaggtggaggcggttgaaaaattacctccacctatttcagtgaagggtgttcgaagtttcttgggacacgcgggtttctatcgatgctttattaaagacttttctaaaattgctactcatttgtgcaggttgcttgaaaaagatgtaactttcaactttgatgacacctgcctcaaggcatttgaagaattcaaaaagaagttcgtgtctgctcccattattgtggcacccaattggtccttaccatttgagcttataggtgatgcaagtgaccacgctattggggcagtgttaggctagaggaaggacaaggtgttttattccatctactatgcgagtaagactcttgatgacgcatagctgaattacaccactactgagaaggagttgttagttgttgtgtgggactttgagaaattttgggtatacttggtgggaacgaaagtcatagtccataccgatcatgcagcaatcatgtatttgtttacaaaaaaggaatctaaggctagattaatgcgttggtttttgttgctataagaatttgatgtataaatacgagatcgaaagggaatagagaaccaagtagttgaccatctatcaaggttggaaaatcacgatcacgtggaggagggtggccaaattaaagaagtctttcctgatgagcaactttttgctatcacctaagaccctccaccatggtacgcagtctacgtgaattatcttgtgagtggggtacttcctcctgaaattgaatctgaagctagaaagaggtttctacatgatgtgaacttctactactgggatgagccatatttgtacaagaaatgtactgatcaattgatgaggagatgcattccagaaaaggaggtggaattagtgttatatgattgtcacgcatcaccttatgggggccatcattgaggagataaaatagctacaaaggtactacaatctggtctcttttggcctactctattcaaggatgcccatgcatttgttaagaagtgtgaccaatgtcagagaataggaacaatcacaaggaggcatgagatgcctttgaacaacatcctagaagttgagctttttgatgtgtaggggatagattttatgggaccattcccattgtctagaggaaacaaatacatcttgctagcagttgactacgtgtaaaaatgggtggagccaattgctttgccaacaaatgatgccatggtggtagctgcttttgtgaaaaagaacatattttcgagatttgggactccacgtgccttaattagtgatgagaggacccatttttgcaatcggttgttgaataaccttctagctaaataaggagttcgccacagagttgctacaacatatcatcctcaaacaagtgggcaagctgaggtgtcaaacagagaaagaaagcaaatattagagaagacagtgagtatgaacaggaaggattgggctgcaaagttagatgatgccttatgggcgtgtagaacttcatataaaacgccaattagggcgtccccttacaagcttgtttatgggaaggcatgtcacttgcccgttgaactggaacacaaggcatactgggccattaagaagctaaacatggaccttgaagacatgggcgagaaaagacttttgcaattgaatgggttagatgagtttaggctgcactcttatgaaaatgctaagctctataaagaaaagacaaaaagatggcatgacaagcatatcaagccgcgtcactttaagccaggccaacatgtattattattcaattttaggctatgattgttccctggaaatctaaaatcgaggtggtcaggtccgttttaggtggtgagagtcactccttatggtgcaatcgagttgcaagctttaaatggtgaaaggaagtttttggtgagtggtcatcgagtcaagcactattaggaggaatgattaatcgtgagaagaccaaggttgtactcgctgataagtaagctagacactgcgtcgtgccgcgatgttaaatcaggtgcttattgggaggcaacctaatttttattgctttccttgtttaacttcttaattttcttttagaatagttagagttttgcattttctttgtaggtatagaaatttgagatataatggtgtaggacgtgtaaattgggtacatataaggctcagaggatcgggttgtttcaaaaataaattgcgaaaacagcgcccagcgctgcctggggcgctggaaagagaatgaaaaaaaccccagcggcatgcagggcgcgaggcgccgggctgggggcggatcaggtaagtttttttatttttttattttttgtttctttgctttctttattaacccatgctcatttaaccccacccaaatacccatttatactaacattctaacctatcctaatactcatacccactcccagtccaacttaaccatcacccaaacccacccaaacacaaaaaccaacatcaaacgttgaaaatttctatagcttctgtcgcgtccgcttcttcctctccaaattttctcagtttttttttctctcttgctctccttctccagtctacaggtatgttcttcttcttcttcttcttcttcttcttcttcttcttctctttctttttgtgttttaatgaatagataattatatacatcccattcccaaaagccccaatcccccaattttttatgtagttcttatgtaatttttatggtgggtggcttgtgttggtcgaaattgtgtgactaatgtgtatacggagtagtaaactagaattccctctacttcattgaaaattagaaggtccaccatatttcaccattgttgaattagaagcacacactttatgcccgcaagatgtttgctaaaatgcttgaaagaggattttggtgcaccggtgaagtatgagtaaccgagtatatttgtgtatgaattttggctaagtgtggggtgtgtagggatgcttttacatgctagggggtatgtctttgatgcaatacatgttcctacaccatctatcttatataatgtatattgtagaatcttgtagatttgactaatttagtatagtctagtagttgtgaaaggtgcgtaccatacacctcttgcttaacttaatgtgaattcgcgtatccataatcaatcattatttgtgtggcatggggaagccttgagtacccatagctttagggtgcaacacttctacatgttggatccaaaattgtgacatagtgtacattatgccttcggttttaagtgtggggtcattttatgacttgcacgacaaccttaggcatatttcttgacaagttctcacatccatgtttatttgtgttgtaggatactatggatcgtgatggttctagcaaaggaaagagcattggaaagtcctccacaacctctccagtgcccaaaaagcgaaagcggggagaaagctctcatggcaatccaaaggataacaggtcgccgagggatctcagcaggtgccattaaggccgaggcctcatttggatttggtcgatgctgcagctatttcatagcacaaggacttcatgccatctgggcagtacatttctgaaattgggattaataccatgaccttagaaagaaacttcccggaggtacttggctggctgcgaactctaaatatgcacaagttcttggaatgcccgggacctgcaaacctgagcatggttcgagagttttatgctaactgggattaccaattggacacttcacgtgtaagagggaaggatgtgccgatggataaagtgtctttatgtgactatttgggggttgagaatactaatccaaggagactccaacgatttatcagaagcccaaaatataagttgatacgtcacactctttgtggcgtagattccaatgctaagtggataaagaagcagggcaacattcacctttctatggttcgctccgacttcaacaaagctgctaaagtatgatagaattttgtacaagcgagactcatgtcggcgaagcacagcagcgattgcactcgcactagagtatgtgtcattttcttcttaatgatcggttgatccaataatgtggctgtgattatgctcagtgagatggcccgcacgagatttggcgacagattaggcggttcttcttcggaaacttgctcacttagcatatgctatttcgaggagtgccggagtaccccggacatgatgaggtggtggaggcaccgtcagggcttatagacatcaatctctattagagacatcgtcaaaacgcacccccgcagcccgtatggagcgagatgagagcttcaataggtacctttataactcgatgaacatactcatgagcagggcaggtattacaaatgaggagcgtatgcatttacgtaatgacttgtccagcacgtccaaggagatgttggggattgcacatggcagccctgttcactcgtcggaggacgtcaactctattaagggctcaaacactgaggatgaggatggaaatggtgctatggggcccatgactttggtgcctctaggaccggatgatgatgagcccagagctactggtggagggcatgctgcggaggtggactccacctaacagggagtttttcttttcaccctactccatatttcatttttacttgcatcgagggctatgcatagtttaagtgtggggtgggaggaatactacctgtgctgtagttatatattttgtatcaacttgtttgatttgtttcttttagtagtgatagtgtagttagtctagtgtagtttagtagctttaaaaaaaagagaaaaaaagcataaaaatacaaaagaaattttttttttttgaaaaaagctcggacttttcccgacgatggatcttttggacaattttcttgagggataaaattctaatttaaaaaaaacaccaaaaagttttttttagaatagctaggtagtattccttggtttttctttgggcaccgattcttttccaaggatgtagctcgaaccgggtacttcttttttttttaggattagtttaggaagaaactgagtcgctctgagatacccatggacatggttgttgctagcacattaggctatgacatacactgtatctttcccatgtatttgttttggattgtgaagcctgagtaaagtaaatagcctattttgtgacgctctctctcagttgtttgacttgtatgccacataatgcaatattgcttaaatttctcaattatgtgcgcttgctcgacttgagagttgaacagaaccgtcttgattgagtcatgtgcaacatgtgtgtgaggatttgtgattttctgttctattctctgtattctagaacttgccccatgtgttaattgaagcgaaattgtaagttgtgctaatctaggagatgacgtaggcattttcttgcttgatcatggatgtgcttgtcacataaaaataaaattttccattgctagccctttgagcctatagacctttcttttggcacccacattacaagtcatgctcctattttgttcttaatttgatattgattaaacctttacctcctaaggcacttagtcgctaaaagaagtaaagtgagatattggggagtagtttttgagtggaaccatggaagggcttgttggtgcaccaaagttgaaataaaaagacactagccaatgaaccttaatgtatggagtgtgtgaaaaaaaaaaagagaaagaaaaatttgcaagaaaaggaaaaaaatatgatagttcaaataatgtagaaaaatacacacctccaattcacaatgatttgtgctagtggaaacatagaagtgcttaattgaaaagagggttatgttgtatatgacaagtgaattgattgagaagaatatgtgcttgaattgtgaatgtagtgtattaaagtgcttaggagggttagtcactatttctaaatgtatcatacccgtcccttaacctacattacaaccttaaagttctaattgatcctagatttggctagcttaaattagtagagatatacactacgggaaagcttatggtacgaccacgggatgcatatgaactctttgtgagagtgaacgaattttgttcaattgtgtgatatccttaatctatattcaaaagtatatttgaatctgtggactatttatattcactcttttgtttgttggtgagggcacatgatctcatgaatgattggtaatattataaacattctcgttggataagtgcatgaattgagggtgcttagtggttgcaagtcggcttttgaggttgggtggtgacaaataggttgctggaattgaaatattatacttgggcatacttaaatggggaaaatgtgaaattttgtgtgttcatgcttgtgtgccggtattgatcatagtcaagggtatagtgtgtggttaaaagttaagatgctcctctataattgagacttgcacgtagttgggggtttattagatagtctcattgctcgagggcgagcaagagtctaagtgtggggtatcgatgtttagcttaaagcatatatatttctatgtatatcgcctcatattttacttttgtttcgtgaatttgggatgttaaatgctatgatttattttaatttgaagtgtttttatatgtaggaatgatttgggagcaattgggggccaaatgcgcaaaattagagccaaaacaaacataaccaaaaaattgtgcatttgggagccacaggcagcgcctggcgccacttgtggcgctggaacaggagctgaaaattgggcagcgccctggtgggcgcctggcgctatccagggcgccgttgacgtgatttttatcctattttgtccgaaacacggcttatgccgccctagacctacccaacacgtataaaagaaagactaagcctatttttgaagggagatacgcactttggaggaaaaatatacacaagaaacatccgggagcaagaacatctcagatttcttcatcttttctagtattttcaattattcgaaacttatgcaattgtttgctagtattataagtggctaaacacccattgttctggggttgtgatttagccatgaatattgttgtctaatgttgacttaacctcgattataattcactaatatatggttgtttcttcgattctgtatttaatttcttacttgtttggccagcagttaggttctatttactatctatgctatgcttgggaaagctgtgtttagattagagaagaattgaagagatcatgatcttaacccttaggggaagcaaatttgtggttaggataggaatatacacagtcaccgtgcttaattaaatatcataatcttaatgcgttcttaatagattgattttataggaatataggcgttaatctattttgaataggcgagtagtacttcgggagaaggctatgagagcaattattgattaattagcaaccatgagtgaattgtatgagagggagagttaattagaacacaatacgaatggtgaatcgatcacaaccatggaatatttgtctctattgaatacataacaatcattctactacttgataatttagttattacctagaattgtagtttagtataattaagctcttgaactcgaatctagcttgactgaataacaatattggtgagttagtgagtagttgatataagtctctgtgggttcgacacttgacttatcattttattacttatacgaccacgtatacttgcgtgtgcgtttgggagcaacaaccatctcaagaaggaatacgagcattttctacgagattcctaaacaaaaagtcacctaattttagggcataatttctatactatgacagtataaaaaatgtatattatcagatcatgcatattaaaatatttcactgatcgtgtataaagtcattttgacatgtaagtaagtctagttgatgattatgacttcactaacttcgctagaaaatctgatatttcaagatgtaattcacattgactgaaaatgatgtacccaaaacaattgaagtatagacattaagggcaaaattactgattattacattttataaagatgaatctactcttcatcaatgcctacaaaataactaaagggtagtggaaatgatgaggtccattcaatcttaacaagagatcttgtattcaagcccggaaaataaatatacttttggtacagaacactttcttcctttaaatgagtcatatgcattgagaatctgaattattcgaaccaattaccaaatgattatatcaaaaaagataattgataatgaaaagggggaaaaaaagagagaacaaaataccaaaacaaggtatctcacgaattcacgatatatattcgaaggcaaacaaatgaaaaaaatagacaaaaatgcgtacatattttttctagactcatgatctatccattatttctggaactgggctctctgtaatactttctaaagatggtttccacttagaatctcttctttctcttcttctttttatttctcccaaaatatcctctaatcttttctcttctttgagtttcaactgaagaaataacatttctagttcttctttagtcaaaactatctttattctcatactattatttccttttttctccgtttcttttttggccttgagaatttcacttgttttttcctctgtttctagttcttgatgaatactttcctctatttcttcccttcgtaaacatgcttccatgcaatttcccattatattgaaaaccctaataaatcgttctttcttctaagaaattgatttttttaatagtaatttgctgtttctgagctgaaagaagaggaaaaaaacagccaaacaataattttgtgtgggtgtgagagagaagagagaaaattgtgaagtgttaacgatagtgcatgtgatggtgatttgactttttatagagaaagaataaacacgtattgaataaaatattgtattagttaattaaaacgagggacttcgctttttgttataatcatctgataattcgttttgcatttaacctatttaaggaaaaaaatatttttatcaaggatcgtttcattctcaaatctcgaatattacactctacagttaaaagttgaggattctcatttattcgatcgcatcttatcgtaatagaaattttacattatttatccatctacagtagcgaactcgttattccccgaggaaaaaaaactcgttattcccaactgccacgcgtccttccaggtcatgctagagcctaagacgtaccgtgttgcaccacattcatatcgtcaaagatttaaaagcttgtctattaaagttgtaaatttgaatatgatagttacgaacttttcaaacattttgaaaattgaaacgccccaaattaaaataaaaagagtgttatattaaacaaaatgtaaagacaatatttttctatctatataatgtattagtgcagtttgaagtgatcaatttatgcctttgactgatattaactcgtaaacgtttgatttgtaaatattttctgcatttaataaacacataaaaataagtaaaaaaaaaagaaaacttatataaatagttggtaaaagaattcttatatgttaataaaaattttaacaagaatatagggtttacgtaaaagttactgggttcctcggaaccaatatatcgtactccagaaccgctcctgtctatacataaataatacatatattatatataaattctaaatatattatatatttatcgatcatttttaatttaacgtattggatgaacgattatttaagtcaattattcaatactttagaataatttaattagcttttaaacttacctcccaaatattaattagctgcggaaaggggttggggtagggatcagagagtaggcaacgatataaatgtcggtattgagtttcatggaaagagaatactacgtagttgctattctaacatgtcagattttgtcccacttaatatttttatatttgttgaatattcttttccaatagctagctagcctagagttgcattagtactactctgttccaatttatgtgaacctgtttgattgagcatggagtttaagaaaaaaatgaagacttttggaatttgtggtcctaaacaagtccaaatggggcccagagtatttgtgtggttataaaagtttctcattaagagtagcgttgtaactttaagctaaattgttaccaaatttaaaaagaattcattctttttggaacggactaaaaaggaaatattagagtactatatttgattttgtcctacttcgtacttttatctttttcttacttgaatattcctttccagtagctagctagctggaaattgtactactaccgccatccaagctttgctttagtgttaagaacacaatacatgaagtcatgaacgtattcgagttaaatgcacgttatgtattttaagtaaaaaagcatatagaataagcatattatttactgagtttcaaattttgcataattggttcctaaagacttataggttatatataaaaagaattgcactattactcttcaatatttaacaaacgtgcaatattatctaaggctgcacgtgacatgtagtgattaataaagtgtgtggattatgataaactctgaggttcaaatttgacaaaaacaaaaaatgtccaaacataaacaccactgtcataaaaaaatcatccaacttgcatcttttcaagcaagtattccttggcaataattcgttatcttactcttttgattaacttttttttttaaaaaaaaggagcattgcttcccccttggttataccattattgaacgcaagaacagttgacaattaattaacgctgcaatttcaatttgctaaaatatgaatgcagaaaagcaaaaggctaatcataacagaaaagtcctttctacgctgcatgcatgtgatggagccacatccaactgcagtcccacttcacctccaaataacaactgtccctctctttccttcctcacattatacacaataaggattaaggagagtgagatgactcgataggtcatccagagttttagaacttaatttcgtatttagaagcctctaatagcttttttaatttttttttgatttgcgtgcgcagtctagaagtttttccagaaagcttttatgttaaaaactgataaaatatgaaattttccttaaaaatttatttgaattaacttcggtcaacgtttcgagcaaacagacccgaatccatattttggcagtcccaatgggtccatatcgtgatttggtacctgggcgtatacttgaaatcgaattcggaggtccctagcttgagttattgatttttgtcgaaaattaaaagtttaaaggttaatgatttttaagaattgaccgatatttgattttgttgatatcgggtccgtattttggttccggagtccggtataggtccattactatatttatgactcgtctgtcaaatttggtgagaaatggagttggtttgacgtgatttggacgttcggttgttaaaatagtagttttaaagttttcttgagaatttcatttgatttggagtccgattcgtagttctaggcgtcattttggtgttttgatcgcgcgagcgagttcgtatgaggtttgtgggcttgtatgtataattggtttgagccccgatggctcgggtgaatttcgaataggctacaaatggttttagatttagaaaatctggtttttcttcagcttcagctgtcatctagtttccttcttcgcgatcgcgaagagtgatcagggcagggtgggatttacttcatcgcgaacgtaatggttgggtcgcgaacgcagagtgttaggggttttaccctcagcaaacgtgaacagcctctcgtgaacgcgtagttttagggacctggtgttgatacccaatttttccctatgtatttcttttacatgcaaatactttcagatatcatagacatacatatataagtatgcccaagtgttttagtatttttcctattttttaagagatttttaaattgatttattgctcaataattattcccaaaattatcactttggtgaataacttattttattctcatatttataccaaaatataggtaggttacttttcatatatttttacaaattaatttggtattttaaaagctaaattgcatataattgcaattttagcctcctttaagatttaatagcattttataattatgaaactggttccaatatttttaaattaatattcatatactattaacggatccagtgcttttaatttatttttaatttgctttcaaaatcattttttactaattttataaaataaaaagggaaaactggctatttaaattttggcctcagttcgtttcaattgtagccccattacatttcgattttagcctaaaattgacccaaattcaaattcaaatttggaccatcccaattccttttgacccaacccctaacccaactcaaacgacccaacccggttccccacctaccttcttaaatctaggccgttgatcattcggatcaacgaccactattcgccctaccataattaaacacaggtgactaccctaatccctcattctcacttggcccgcttcctttgaatcctaaaccctctcaaatcctctcaaaaactctccgaaaccctagcctcctcctacccccttttcaaccaccggtcaccggaatccatggcttctcaggccatggatagttggtactcacctatcttcaccagtaagccagggttgttcgaagcttcgaggcctgaccttgacgattccctctccgatcttctcagacctttgatttcatggctcctccggccatgctccggcatattcaagacttaggagcctgattcttgacctctccgactcaagatcagacctgtttccaagcctttctcatttctagggtttctccgaaaccctaagctattcaaggtcctttcaccgttattttcttagatctatactgtatctatacttttcttgccatctaaagtgttttccccaaaagtttcttttcaaaatcgtttctcttcgattttagggtttctgaaaggattttttgggaaaaatctttctgatttttcttcttctttactttatgtgtgtttgtccataccctgctggtgtgattactctttattacgcatgtactatcttctaccttttcttttctgctatgcatgttactcctgttaatccctgcttagttttctttactcttttactatgtgtatttaccgttaagttatttgatcttgtttactggactctgttcatgttcttacatgcttcatctacttgtgttcacgtttgtattatctccttcttctgaacttgtttagcttccgagttttctcaaatatgttcttcatgatttttcttcctttgtcattcaaacgtgctatcatatctattttgttgagactctgaaacaaatgacttgctttctcacttccatgtctgattcaattttgaaaccctaggatttggggggtttcctttgacgattttgatttttgtgttcgagttaaggctacactttgggaccctgaactctcagactcactatgagtctgcaaattgaacctgtatctttttgcttatgattctgaacttctcttcgatcaaactctcttctaaataatttgacagcctcttcttgattcacatatttgtgtcctttatatatgagaactcttctttcaaaaggttttgccaactactaattgatttcgaattcctttaatggtgtttacttgattgctactgattttccctaattgaacctttctttaccctttttctgacttggttcattcgaacaaagcttgtagctttgattttactggctatttgattaattccctttccttatttttcacaaaccatgtaccattggacttttgccttaaataaaccctgtgtatttacccttattatgttactttggaaaaggttttaatcaaattctttccgtaattgtcttatgcccattcgaaagcagaatcccttaaccaaagggagactttatgtgattgattgcaaactatttccttaccttttcttacttgttttctgcactataaaaggggactacccttctacacttgaacacactttgaattgcatactcttacacacacacactcaattacaatactctttcaattctctactctcttctaagatcttttgtactgcttgcttgcaatttggcttacaagacttctgctttcacttatttgtttccctgaaactcgtatgtcctaattttaattccagcatcatccctatgtgtttactttacagttgcgacactcttggctattttcctgttcatgttttgtattgaatatgctactctctctttgcatctgctgtttgttgtgaattccccatacccctactcccttctatatgtttgagttaaggtttatggctgtgagcacgtgatttttgtttcgcacgacaatcgctccaaaagaaataataaaataataataattggccccactgtacaaattttggattttttacatggcactttgttggttatttgcgatttttgcccatttttactttattaaaacaaaatacaaaaaatgtgtgtgtcatgcataattcgaaccgtaatccggtcgttaaatagaaaatcatgaataggcatcttcgtccgtgattttattttgtttgattttacctgttttgaattatttttagtgtgtgtgcaaataattgtgttgagtgtgtatttaattttaatttgatttttgcttagttttgtttttttaaaaataaataagaataataaaaaaaaagaccctttcttccgaattgggccaatttattaaaattggcccaaacaagcaatgcccaaaccaggcctgcccggtccagtccagctgatgcccagagagtccaaacgacgtcgtttgggtcgtgcctgatctgggccgttgatctcagagtgatcaacggccaagatcaattccccataacccaccaataaacccgacccgtctcacccggaccgaccccaaccctttacccttgaaacgacaccgttccacttaagccatcagatccagaccgtagatctagattgatctaacggttgagatcaatccacccactaactatataagttcataaccttaccctgcccccctatccaataccccagccttcgtctccacagaccaggcccctaaaccctagccgcccctgtatactttcgccatgaaagccggcggcatggacgccggtgaccttccccttaacaccctagaacccccttgccatcctaaacatggatctgttaaccatgtagttcgaatccctccccaccttctcgaatcttcattcgaagattcgagtcaaaactcgatctacacagtttaaccccagtttcacaccagacactccccagacccccctcgtgaccaaaccatacttggtttggtccgagtctgaccagggaagcatgaatcccggatctgagttttggaactttgtagttcttcatcactggcccatgtccgtccgagccaaagagattaaggtctaatggaccttaatcgaagtgtttctcatctgagaaacacttcgattaaagtccgttcagccttaagaaaggtctgtccaaatccgagttcaaacttttaacttttcaagttttaaggtgagtctgctttctttcctttatttgttttagtccgtgtgatttgttttaaaagtctgttcatatttgttttaattttatcaacttttgtttgtccactttacttgaacctctgtgtttgtctgaatcccccctcctattctgataaggcatgtgcattggttgtattccaaatttgtactgactaactgattcctcgaagtataattttgtttaatcagtataagtcgagtcatgtgtcccatgcttttgaatgtctgatttttggctacgcttgtgtatgttaatgctaatatagtcgagtcgacatgtgtcgtcaattagttttagctatccgaacaataacaaatcgacttacttctgctaagcatttgatgaatcaattaagaaccagttttggtttacctatagctgtttgaattgatcagtaatgtaaaagggatgtttggtttaaattctgaattggaaggcatgtgcactcgtgcacaacatgtgcattggtgcacctcatgtgctttgtgcacagcctgtggcctgcataaaggtctttgttaagttttaaacaatttgacagaatatgctgtcagatatattctactgcccataccttgctttaagtttaaaaagtattaaaccttttacaagttaagtctgccagggaatgttgatggaggttatatacttaaaaaactaattggaatctaaaaaggggaaggcacatgggagggtactgtgatattctaaaacaggctgttaaaaggggtagtgtttaggcttataaagaggaggacttgggagatagagaacgggagcagatctgagaaaagacagacctaagagaggattagaggttagagaaccctgaaaatttacagaagagaaatacatacactgtgaggatagaaaagaaaaaagaaagagttgacagaaatagaaagagagcaagaaagagataaaacagattaggaaatcagaaatttggtcttgtttgtctgaacttcatctattgtcaatacattaggcagtgttgcttcttctaaatttcaatcgagattattgttagtgttttgttgcatttggtatattccggaattggattgtctggagcattgttgccatcacactgtgtgctatttcgtttggctgtttttttcttcaactctagttccacctcgcaaaagaatcttttctgttgtgctgttctgattgctgctgctattctgctcactattgttgctgccctgtcctgctgctattgctagtcctgtttctttctgctgctgatttccacatcttcttcttcttctcctttgcattttcagcatttccaggtacacatttcaagtcccatattgatgtaattaaaatagttggaaagcatgaaatgaaaaaaggttgaagaagttcaagtatttgttgtaatattcatagtacattaacaggcctgtgaaaattgattagtttataattcaacagttcgaaagtatgtactgatattcgactgagtttaccctgttgtattttagctcggtagttgtttgtcagtaggggcatgtatacttcgtccttatacaatactgctcctgtttcatttagtcttttttagttaagactagtccacataagtttagttaagttcaactcgagaagtgttcggattaagtgttgtatttcgtttagctcgtacatgattccttgtcaaactaaagtattttactttgctagttatcctttaatctagtccaaataagttcagttaagttcaactcaagaaatgttcggattaagtattgcatttcatcaatctcatatgtaatcttttgttcgaccaaaacattctcgcaaggcatgacgttttttactttataagtagttaatcagaaactgacaagaatccggattaggcaaaagcctataattgaattagcatgtaccttttcttctagttttagagacaaatgcattagaaatgtagccactttaggatatcctttctaaaatagagatgagcctcgccaaataaagatgcaaaattgcggggccctcaataaataaccatgataattatttagaattcaggataggccatttaataaatttcatggccttctacaaagataataacgcgttagattctttaggagcgactttaagtaaactatattcttaaaatcgggtgcattgactgtgacgtggtttgagatgcatttctacgacgttgcaattctataaaaataatgataataataaaagcgatttaaacttaataaaagcacataagacacaacatgtatttaaatcagatatttagccattataacaatttaagcgaccgtgctagaaccacgggattcgagggtgcctaacaccttccctcgggtcaacagaattccttacttagaatttctggttcgcagacttcatttggaaaagtcaaaaatttcctcgatttgggattcataataaaccggtgacttgggacaccaaaaaccaaacctttcccaagtggcgactctgaattaaataaataatcccatttcgaatattgtcacttaaattggaaaaactccacccgcgcatcttacccctcggggcgggcgcgcaaaaaggaggtgtgacagctctggcgactctgctggggatgtaacccagaaccactggttcagggttcaagaattcgagcttagaataattgttatatttggctttattatctgatctttattacatgtttttgcataacgtgctaaatgttgtcttttaccgctttgatattatctgaactgtatataaactgtgccgaaacccttctcttctcaccttcggggagaagctcgctggtcgagactccctattctgttagtgtcaatacctgaaataagaaagaggtcggacaaattacaaagccggacgatctcgcgggtccccggtacgtagccctctcctcgactcgagttgtccgctcgggtacccagtcgagaacaaatacccaggttacgaacctagaataacttgacttcatgccggatccctagtaggaacgtttatttgcatcatgttgcatttaacttagggggctcaacacaggggttgggtccgtctaggacagacaacctgaaatgaaaagaccatcctgctacatcttgtttgttttgcgcatttatttgcttcagatctgcatgctgaccggtttctaaaaaggggaaaaatagcagcgtagggagataattacttatttttggaaaaataaaaccaatgtccaagtagtgtcaaaaccttgccgaaatttttctaaaaaaaaatgaaaacaaaaactatctttttattgagagttattaaaaaaaaatatataaaaatttttcttttatcgctttcaaaatcaaaaaaagaaaaagaaaaggtatttattttaaaaaaaaaatgtgttgtttcttttgtagtaccccttttataaattcagactaatagtccgaatattgcctagaaaagaaaatatttttctttagtctttatcttttttcaaaaaataataaaaatacttattcttgatttctaggtttgtttgattttctctattcatgatatgcccgaactacgccggtttgattctcaccggatgtgagatacgtaggcaaccctcgtcgggttcaaccccatttttgctaaaatagccaaaatcaataaatatataaaaaatgtgtcaaagagtcgtaaataaatcgggtgacgttgttttgtcataaatagccgaatgttcctgaaagggacgccggaaggctgactttgtctaaatagccacctttgggtcttatttagcatttttacccagtagacccacacagccttaaaatcttcatccccgaagtgtttaaaggccgtgttcaaaacttgatcccctctgtaaaaatatttttgagtcagtcattcttgttaaaatcaccttaataaatgtgcaggatgagcacgatgcaaaatgaacatttttcaataatgaccaaaatccctgtcaagttacggctatggtggaatgatctaggtgttgaaggacaaaatgaggttaagaaatatctgaaaggtcttgtgggtctgttggaaatccaacctcggggagatatcataagggctttggttacctattgggacccggcgcacaatgttttccatttctctgattttgaattcaccccgactttggaagaaatggccggatacatcgggaatgctgagcttcccttgagggaaaaatacttggtcgccccaagagtcgtcacggtacatcggttcctggattcattgaaaatacctagaacagtccacaacccggatctagcagccggattctgtactccatgcttcatatatgataggtacggtcacgaggggggattcaataatccaatcaacaaactgtgcagcaaaggagttcgtcagaagtgggacgagcacagacgggtagcgttcatgataatgttcctaggtcttctggtatttccgaggaaagatggaaacattgatttgaagatatctggggtcgtcagcactttactcacgcaaagtgacagtactctcgcgccaatggtggtatctgacatctttcgagctctcacagcttgtaaagctgggggaaatttcttcgaaggttgtaacttgctcctacagatatggatgaccgagcacctctgccatcgttccgagatgttgagccatggttccccggaaaagacccgcatagaagaatcttacgcgagaatcaaagagatcatttggcccaaaggagtcctggcatggacctcgttcttacaagctcttactgccagccaaatacaatggacgttgggatggttgccttttgatgagatcttatatatgtcggcagctaaaactcatttcttgctgatggggcttaagagcattcaaccttacgcacccggctgagttttgagacagttcatttcttagcactcaagcagtcgagataagtcctaacggacagttcccagaagcaaagattcgccaaatctggaacgagggtcaatatttgaaatcagatacttgcgtgcgggatctcgccaaaggagaaacggcgccaggttaccttgcatggtatagaagggaactcgagcatgaaaggccagctaagagaccccacatccggaatttcaccgactcatcgcaaaggcattgggattgggtagcaaaggaaagaggctattgtgctgaaatcagcaggttaaagcaacaagtagaaggcatgaaatacgagcacaacgtgcaaattgctaccgatctaggagaacggaacaggttaattcaagaaaatgaaatgctcagagcccagatcaaacagataaggttggatgcagataaacagccaaggcgtcgatcagacgagcacctgataaaaaggctaaaaagcgagatcagagaatggcaagatggtttggagaaatctgaaaacgtcatagcagagctcaaagcacagtgggatacaagagcagataagcatcgtcgatacctgaatcaattggaagacgaccacgaaaaaactattgctaaaataaagagagagatggctgcacttgagatcaaagcggttaatcaggccaagaatttccaaattgagagcagatactggtgcgactcaatagcctagatgaagttggaagtacggcgactaaagcatcagcatgtacaagatgctcaagtcttcgagatatgcagcaatcagataaaacgcctgctcgtagagaagaagcaaaccagagataggatcaaggctattgcccatgccatcaccagacgatgtctacgatgtgagaacatgtccagcgttaccgtcctctcggcagtaatgggttatgtcaagcagactatgcacgagctggagcaacttgagaaggatatcacgcctaaggccgcggcgaggccgaacgatgccccgcggaaaccaatttttaaaaccataatgcactcataagtcaaatctgtatcttagcactttccgcctgggtgatttttagtctattttttgagtctagttttattttcaaagtttgctctttcttttgcaaaatgtagcttgtaatagaacgtttcaacaataaagaggttttcttttacgctcatttgcgtttttcgaactacgtaatgatctgattcacgtaggcatcatgatacgtaggcaatcctcatcggatccggtcgcatttcttttactgcaaaataaaacaaaaagaaaaaaaaagaagaaaaaggaaagaaaggaaaaactaataaaaggaaaaatgccggaatgacgcatgctctcgtagcaaacatatagtaatctacttaactgtataggtgcatcatgcccaacgtgagattaactatctgttatttgctacaaattaaccgtgcgtttgtcgttgagtatttccagggtttttgaaaggacggttggtttggtgaaagtctggcctcgcactcatatttcacgaggtcaaggagaagtgttcaactacctgttgttagggccagaagcagtactcacacttacttcaccaggtcaaaaggaagtgtggaaatgtctttagaaattccattgcaaacaatccctgtttccgaggaaagctcgatctcaaccgtcctcacacctgaatccacaactgcggaggaaaataggatcctacggctccgcatgttggaaatgctggacgactggaacaacgggaaagagccgccaagtgtcgtccccggattccctgaattattctccaggtcaagtggaacgtctaatgtccccataaattatcctgctactccatttgggtacccagccacctcagccttctctgctggatcgccttctgagcctcatccccgaatgtcggccaccgatgcaagcatgaacatctttactgcatcgccttgcccggttacggcacaacctaccacatacaagccaagctttgactcatcctcttttacattccaagcaccatcgttctcaatggaaccaaccaggttcgctaccaacactaatcctctaccgcctcagtgcgagcttgcacccgggcaggatcagaaccccagaattgcagaacaaaatgagattgccaagagaatgagaagccttgaacaaagtttgaagaatatgtaaggattgagcggacaaaaaagcgtctcttacgccgacctgtgcatgttccctcacgtgcacctgccaacgggtttcaagacccctaagttcgagaaatacgatgggcacggtgaccccattgcgcatcttaagaaatactgcaaccaattgcggggagccggcggaaaagaagaactgctaatcgcatattttggggaaagtctagtagggatagcttcgaaatggtatatggatcaggaaatgtcccgatggcatatatgggatgatctcgccagagattttgtaaaacaattccagtataacatcgacattgcaccagaccgaaactctctgtcgaatttgaaaaagaaaccttcggaaagctttagaaaatatgctattaagtggcgtgaataggcgtcgagagtaaagcctcccatggatgaagtggaaatggtcactacctttctccaggctcaagcgtctgactatttccaaaacatgatgtcggccatgggtaagccattcgcggaagcgatcaagattggagagatggtggaaaataggttgaaaacgggtaggattctgagtcaagcagccataagggcaacttcccaggccatccaaagcgggtctggaggaacgacgagggggaagaagaaggaagaaacgactatggcagcctctgaagcaagggagtatcgtcatcccaggcccaattttccggaaagagccccacaacactattacccccactcaaatttggcatatgctcatcagccttatatggtcatgaatgcccaaccttataaccatccaccacaacaagccaaccgaggcccagctccacctcccagaaatcagcctccttaccgcaaccactataacccacaacccccgcagaataactaccgcccccaggagccacctcgacggcggacttttactcccatcggtgaacaatactctactttgttccctaagctagtccagttgggtttcttgcaaccaattccccaaacgaggcaaaacccaacatcgccttcttacaaagccggagtcagatgcgcctatcattcaggagccgagggacatgatacaaacgactgctggtcattgaaaagagtggtcgaaaatttgatagagtaggggaaaatagtgctaagggacgaagagatcccaaatgtgactaacaatccattgcccgctcacaataatgggccgctgatcggcatgatttgtgaagacaaagagttcaaccctgctttgaaagccataattgccattgtcgacacggggaagaggcctgaaatagaccagaaatcagaaaagggggaggaggccaaggctgtaaagagcaagcctgaaaagaaggtggagaagaaagtggtaccagcaaagggtggagttctttacataccacgaggtcaagccgagaagacgcacaacttcgggatcaaaaagacaagacctatgtacgtgccgaaaggggcctatgtggtccgggggacgattcaaccacctcggctgaatgagccagtggttatcagacgcgtgccacaaaagccaatgaccaacccgtccacagtaccgtggaattatcaaaagactttggtaatgtacaaaggtaaagaggtcatgggagaacttccaagaaatactttcattggagggtactcaaatacccaagaactgaacaacgccacacaaaggcgcttccctccaaagaagcctgtgagtgttgaagaagcggaagtgttcttccaacaaatgaagatgccggattacgaagtgatagatcagctgcgcaagtaccctgagcaagtatccatgctgtcattattgatgaggtcgactgagcatcaaaagatcctattgaaaaccctgaatgaagcatatgtaccagttgaaacctcggtggaacaactagagcagatgacagaaagattcttcgctgtcaaccaaatctctttcagcaaaaatgatttacccccagaaggagcagcacacaacaaggccttgcatttaacagttaaatgcgaggactactatgtcaagagggtaatgttggatggaggctcaggcgttgacatttgcccgctctccacgctacaaagaatggaaattaggactggaagaatccgacccaacaatgtctgcgtaagagctttcgacggcatcaagagagataccatgggagaaatagacctgttgttggtcataggaccagtcgaattttgagtaaccttccaggtgatcgacatggacacatcctacaatttcctccttggcagaccttggatccatgcggcaggagccgtaccttccactcttcaccagatggtgaagttcgagtacgaagaccgagagatcgtggtccatagggaagatgagcatgccatttatcgggacccatccatcccgtaccttgaaccaagagaaggaagcgaacatacggtctatcaagctttcgaggtcgtactggcagagcagtacgaagagggaataccctgcccccagcctttcttgtctaatgcctcggttatggtggccaaagagatgatccggcacggatttaggccagggaagggacttggacgaacccttcagggaataacagaacccattactttgccagtcatcaagaaaccttttggactaggcttcaaacctactccagcagacgaagaatgggcaaagaagaggagagatgagggctggaagttacctcaaccactgccggatttatatgcaactttcatcgggccaaggtacgttgaagaagatgatgaggtcttaacagctgaggaaatcgaggatatatgtggggcaatgagggaaatgctctacgagatccacatggtccaaccaggtgaaggaacgagcactgcagagatgctgtacatggggccgagcgcccaactccaaaactgggaggccacgccattcccgactagacggaagtccggttagacatgtcctgccacctttactgtgtcacaagttatcccaggacataacttgaacgttttcttcttttcaattgttgctttgaattcctagtcgtaaacattgctgtcttccaactttccaaagaaaatatatataaaaaaatcatcattgctttcctattctttcttttgttctgatttttattagttttccttttatcttccttttcagtcctaataatgcggctttaaatatgacatgcttgcggacttcacgcccagatcacaatgagttatttaactgcgaattaatgaacccagaaccagaatatgatgcggaggaggcttttagggagataaactgagagttggaatatttcgagaataaacctaagccaaatctgaatgacactgaaccagtaaacttaggaaccccggaagaagtccgggagaccaagataagcattcacacggacaagaaaacgcgagaggcgataattcaacttcttcttgaattcaaagacgtgtttgcttggtcatatgatgacatgccgggactaggtgttgatctagtggttcataaattgcagattcatcctgattgtcctccagttcaacaaaagcaacgaaagttcaaaactgaggtcagtgacaagattaaagaggagatcaccaagcagctgaaaacaggagtgatccgggtagtccaatatacaacatggttggcgaatgtggttccagtaccaaaaaaggacgggaaaactcgagtatgtgtagattaccgagatctgaacagagcaagtcctaaagacaatttcccgttgcccaacatccacatcctcaggtactgatggatgaagaggacgccgagaaaactgctttcaccacgccttggggcacctactgttaccgggtcatgccatttggtctgaagaatgctggggctacttacatgagggccatgacatgatgcaccaggaaatagaggtgtacatggatgacgtgatagtaaagtctaggacgcaggataatcacatccaagacttgaggaagttcttcgagaggctaaggaagtatgacttgaagctgaacccagctaaatgtgctttcggagttccgtcgggcaaacttttgggcttcatcgtaagcaggagaggaatcgagctatatccaactaagataaaatccatcagagacctacctcccccgagaacaaagaaagacgtgatgagtcttttgggcaggttgaattacatcagtaggttcattgcccagctgacaagcacgtgcgagcccatattcaagctgttaaggaaagacgcggcgatcaaatggacagttgagtgtcaagaagcctttgataaagtcaaagaatacctttcgaatcccccggtcttggtccctccagaaccaggaaggccactcttcttgtatctgacagtcttggagaactctttcggctgcgtcctcgggcaacacgacgtaaccggaaagaaggagcaggcaatttactacttgagcaagaaattcaccggctacgaggccaaatacactctgctggaaagaacatgttgtgctctcacatgggttgctcaaaagctgagacattatctccaagcccacaccacgttcctcataagcaggttggatcctttgaagtatatatttcagaaaccaatgcctactgggagactggctaaatggcaaattttgcttacggaattcgacatagtttatgtcactcgcacggcaatgaaagcccaggcattagcagatcatttggccgaaaatccggtcgatgaggaataccagcgattggatacctactttccagatgaagaggtaaacaccgtagaagtgatctcggaggaagctcatgtttggaagatgttctttgaaggagccatgaacgccaagggtgtagggattggggcaatattgatatcgccttccggtcagcattatcccgccacagctagactgcgtttcttttgcacaaataatacagctgagtatgaagcctgcattatgggcatgcatatggcaatcgatcaggatgtcgaagacttactgattatgggagattctgacctgatcatccggcaagctcaaggcgaatgggaaactcgggatgtcaaacttatcccataccaacaacatgtggaggacctcagcaagcgctttacatcaatagaattcaggtacattccgaggtgtcacaatgaactggcagatgcacttgctactttggcttcaatgctaccttacccgggcaacgcccacgtcgatcctttggaaatccaaatcaaggaaagacacggttactgcagtgtaatcgaggcgggatcaaatacgcagccttggtaccatgacatcaagaggttcctgaagacgcaagaataccccgagcacgctactggagatcaaaagaggaccattaggcaacatgcaagtggtttctttttgagcggtgaattgttatataagaggaccccggacctcaatctcctaagatgtgtcaatatcgaggaagcgaaaaagatcatgcacgaagtacacgcaggtgtgtgcggacctcacatgaacgggtatgtcttagcgaagaaaatccttagagcaggttactactggatgaccatggaaaatgattgctttagcttcgttcggaaatgtcatcagtgtcaggtgcacggtgatttgattcatgcacctcccacggaactgcatcccatgtccgcaccttggccatttgtcgcttggggcatggacgtcattggaccaattgaaccaaaggcctcgaatggacacaggtttatattggttgccatagactacttcacaaaatgggtagaggctataaccctcaagtcggtcactaagaaagctgtggtggattttgtacactcaaatcttatctgtcgcttcggtattcctgcgactatcattacagataacgcagcaaacttgaacagtcacttgatgggagatgtatgcgagcaattcagaataacgcataggaattccacgccttatcggccaaaggccaatggtgctgtggaagcggcaaacaaaaacatcaagaagattttgaggaagaccatccaaagttcccgacagtggcatgagcagttaccatttgcattattagggtaccgcactatggtacgcacatcggtgggagcgactccttatcttttggtttatgggaccgaggctgtaataccggcagaggtagaaattccttcgcttcgaatcattgtcgaagcagaaatcgaggacagcgagtgggtcaagactcggttagagcaattgactttgattgatgaaaagcgaatggccgcaatttgtcacggacagttataccaacgaaggatggcccgtgcttacaacaagaaagtccgaccccggaatttcgaagtaggacaattggtactgaggcgtattctgccgcatcatgaggaagcaaaagggaagtttgctccgaattggaaaggcccatacattgtaaggaagatattgccaagaggagcattgtatctaggtgatatcgaaggaaatgaccccgacacagcagtaaatgcagatgcagtcaagaggtactacgtctaaatcatactccagtggtcctgacacgtttgaaaatggcgaaggttttattccccactactccccaaacactacccaattctctctaccaacttttgagccgcttacaaaacaaaaaaaacaaaaaaaaagagaagaaaacaaaacaaaacattgattgaggcctgaactacgtttgacttgattccgaaaggatacgtaggcagcctctccctgaggttcagtcacaccaacaataaaatcccattcaccctgaaattgaaaaccggggcacgtcgagcagttgagaagttagtatcatctacctctctttaccgagtacaagccttcaaatcaattaccaaatgtggtgggaaacccataagcgtcgcaaatggagaccagcacactctgaattgagagaggtaaaatgagagagtctcgtcggtgaaaaccttcgggcaccacgaggaaacgggagtaaagaaaccaaaatgagagagcttgtttagtaaaaactcgcaaagagtgctatcaagagatgacaggaagagaaatgagagaggtcagccagcgaaaacccgcaaagggcgctgttggccgaaaaggaatgactccaccccaaggaggtctcggcaaagttccaccaggtttggaatcacagatccgttctggtccagagaaacgcaagttcgtggaatatcaggcgtccagtccaaagagcatgtcatgtcatctaaagccagcgttatcttcctcagataagtctttttctcgtcccgaaaagggcactcccttcccaaaatttgttttctcctcaaaccccttttgtgttttaaccccaagttcaggatacaccggaaaggacaggtggcaggtttgtttgcacggaattccgtctcatgaaggaaagcgcctcgtttcgttggtacgattgcccaagcttgatggatcatgacgtttgatggtgtttaaagaggaaagagagaaatcctccccagcaagtccgccttcaaataaatccccacagagtctccccctgtacaaatccccacagagtctctcctattgtacaatctcccacagagtctccccaatatacaaaaaataaaaaataaaaaaaatggaatctccccagcatatcccagcgagtccttttgtaaaaattccccagcaagcttaccccaacaaatcctagaaatcccgctttgaaataaatccccagcatgccccattgtacaaaaatccacacaaaggatccactttgtaaatattccccacagagcttcctttttgtacaaattcccacaaaatacctccaataaaatccccgttgagaacctccaagcaaaacgggacacacaaaaaaaaagaaaaaaagagccttacgaagcaagtcatcacagaatccggaaatacaagcctgagcagtctaaaagtttcgccattcgaatcaaatcaatggcgggacttcgcaacaaaaatagagacgcaacaaagcaattgggaacgatcaaggtcaccgaaccgaccgtcatttccgaactaacaattgttctttgtctgaaaagttgaaacaggtataatccaagacaaccgtgcaagaagcaggtgtcgcccaaagaagaaggtacacgggtacaagaaacattttggcaataaggaattcactcaaaaggtaagttcccgcaaaactcccttttatcttctattaaaacaagaaaactcaaaaaaatagatcgtgtagtattctcgaactttatccccagccaatcagcattagggttttaaaccctaaactgaattttccttttagtcagcattagggttttaaaaccctaaactgaactttttcctttcagccagcattagggttttaaacctaaactgagctttttccatgcaatcagcattagggttttaaaccctaaactgaactttttcctttcagccagcattagggttttaaaccctaaactgagcttttccatgcaatcagcattagggttttaaaccctaaactgaatttttcctttagtcagcattagggttttaaaccctaaactgaactttttcctttcagccagcattagggttttaaaccctaaactgagcttttccatgcaatcagcattagggttttaaaccctaaactgaattttccttttagtcagcattagggttttaaaccctaaactgaactttttccattcagccagcattagggttttaaaccctaaactgaatttttcctttagtcagcattagggttttaaaccctaaactgaactttttcctttcagtcagcattagggttttaaaccctaaactgagcttttccatgcaatcagcattagggttttaaaccctaaactgaattttccttttagtcagcattagggttttaaaccctaaactgaactttttcctttagccagcattagggttttaaaccctaaactgaattttccttttaatcagcattagggttttaaaccctaaactgaatctttctttagtcaggttttaaaccctaaactgactttttcctttagtcagcattagggttttaaaccctaaactgaactttttcctttcagccagcattagggttttaaaccctaaactgagcttttccatgcaatcagcattagggttttaaaccctaaactgaattttccttttagtcagcattagggttttaaaccctaaactgaactttttcctttagccagcattagggttttaaaccctaaactgaattttccttttaatcaacattagggttttaaaccctaaactgaatctttctttagtcaggttttacaccctaaactgaattcttcctttgcaaagcgttggggtgttaaaccctaaaccgaacctttccccagctagtcggtattagggctccaaccctgaactgagcatgcatatcctctttcatcaattttatgaacttcctggcgaataattaacaaaattttcctagtgaaactggggcagaaaatttcgttcgtttgttttctcccgcaggtctaacctcgagccacatggatcgaaacgacccatgagatgagtcccagttcggaatcaaagaaaaaaaaaagagagagaagatgtcccgagatatcggaaggcagattgactccaacatttgattaagatcctgaaccctgccgatcgcatctcactcagtatcccagaggttaaacaagtcgccgtgacttgcaagcatcaagattcagatcgaagtctacaagcagaatcagctaagacccaagatcaagtcgtaaaagaatcatagataggaatcttgtaactagcagttgacatgcatataagtagttagttcagtttccaattttcgtttggttgtaataaggcgtttagtgatacagcagtgacaacagcaacagcagtagcagcaagcattgcaatcccatggtagtcccagctaccaaaacttctcgaactacattgacctgattcctgtttagcccaggatatgtaggaaatctttgaagcaagattcggtcagatctttcaaaaacatgcttcatacggagtggtccataggcaaaaatcgctcatacacgctcactttatctttgcacggaaactcttcgtgtttccgaacaaagaggggcagctgtgagcacatgatttttgtttcgcacgacaatcgctccaaaagaaataaaaaaataataataattggccccgctgtacaaattttggattttttacatggcactttgttggttatttgcgatttttgcccatttttactttattaaaacaaaatacaaaaaatgtgtgtgtcatgcataactcgaaccgtaatccggtcgttaaatagaaaatcatgaataggcatcttcgtccgtgattttattttgtttgattttacctgttttgaaatatttttagtgtgtgtgcaaataattgtgttgagtgtgtatttaattttaatttgatttttgcttagttttgtttttttttaaaataaataagattaaaaaaaaagaccctttcttccgaattgggccaatttattaaaattggcccaaacaagcaatgcccaaaccaggcctgcccggtccagtccagctgatgcccagagagtccaaatgacgtcgtttgggtcgtgcctgatctgggccgttgatctcagagtgatcaacggccaagatcaattccccataacccaccaataaacccgacccgtcacacccggaccgacccaaccctttacccttgaaacgacaccgttccacttaagccatcagatccagaccgtagatctagattgatctaacggttgagatcaatccacccactaactatataagttcataaccttaccctgccccccctatccaataccccagccttcgtctccacaaaccaggcccctaaaccatagccgcccctgtatactttcgccatgaaagccggcggcatggacgccggtgaacttccccttaacaccctagaaccccctttgccatcttgaacatggatctgttaaccatgtagttcgaatccctctccaccttctcgaatcttcattcgaagattcgagtcaaaactcgatctacacagtttaaccccagtttcacaccagacactccccagacccccctcgtgaccaaaccatacttggtttgttccgaatctgaccagggaagcatgaatcccggatctgagttttggaactttgtagttcttcaccactggcccatgtccgtctgagacaaagatattaaggtctaatggaccttaatcgaattgtttctcatctgagaaacacttcgattaaagtccgttcagccttaagaaaggtctgtccaaatccgagttcaaacttttaacttttcaagttttaaggtgagtcttctttctttcctttatttgttttagtccgtgtgatttgttttaaaagtctgttcatatttgttttaattttatcaacttttgtttgtccactttacttgaacctctgtgtttgtctgaatccccccctcctattctgataaggcatgtgcattggttgtattccaaatttgtactgactaactgattcctcgaagtataattctgtttaatcagtataagtcgagtcatgtgtcccatgcttttgaatgtctgatttttggatacgcttgtgtatgttaatgctaatatagtcgagtcgacatgtgtcgtcaattagtttcagctatccgaacaataacaaatcgacttacttctgctaagcatttgatgaatcaattaagaaccagttttggtttacctatagctgtttgaattgatcagtaatgtaaaagggatgtttggtttaaattctgaattggaaggcatgtgcactcgtgcacagcatgtgcattggtgcacctcatgtgctttgtgcacagcctgtggcctgcataaaggtctttgttaagttttaaacaatttgacagcatatgctgtcagatatattctactgcccataccttgctttaagtttaaaaagtattaaaccttttaaaagttaagtctgccagggaatgttgatggaggttatatacttaaataactaattggaatctaaaaaggggaagacacatgggagggtactgtgatattctaaaacaagctttaaaaggggtagtgtttaggcttataaagaggaggacttgggagatagataacgggagcagatctgagaaaagacagacctaagagaggattagaggttagagaaccctgaaaatttacagaagagaaatacacacactgtgaggatagaaaagaaaaaagaaagagttgacagaaatagaaagagagcaagaaagagataaaacagattaggaaatcagaaatttggtcttgtttgtctgaacttcatctattgtcaatacattaggcagtgttgcttcttctaaatttcaatcgagattattgttagtgttttgttgcatttggtatattccggaattggattgtctggagcattgttgccatcacactgtgtgctatttcgtttggctgtttttttcttcaactctagttctacctcgcaaaagaatcttttctgttgtgctgttctgattgctgctgctattctgctaactattgttgctgccctgtcctgctgctattgctagtcctgtttctttctgctgctgatttccacatcttcttcttcttctcctttgcattttcagcatttccaggtacacatttcaagtcccatattgatgtaattaaaacagttggaaagcatgaaatgaaaaaaggttgaagaagttcaagtatttgttgtaatattcatagtacattaacaggcttgtgaaaattgattagtttataattcaacagttcaaaagtatgtactgatattcgactgagtttaccctgttgtattttagatcggtagttgtttgtcagtaggggcatgtatacttcgaccttatacaatactgctcctgtttcatttagtcttttttatttaagactagtccacataagtttagttaagttcaactcgagaagtgttcggattaagtgttgtatttcgtttagctcgtacatgattccttgtcaaactaaagtattttactttgccagttatcctttaatctagtccaaataagttcagttaagttcaactcaagaaatgttcggattaagtattgcatttcatcaatctcatatgtaatcttttgttcgaccaaaacattctcgcaaggcatgacgttttttactttataagtagttaatcagaaactgacaagaatccggattaggcaaaagcctataattgaattagcatgtaccttttcttctagttttagagacaaatgcattagaaatgtagccactttaggatatcctttctaaaatagagatgaacctcgccaaataaagatgcaaaattgcggggccctcaataaataaccatgataattatttagaattcaggataggccatttaataaatttcatggccttctacaaagataataatgcgttagattctttaggagtgactttaagtaaactatattcttaaaatcgggtgcacattgatgtgacccaaatccaagtctcgacggagtcaaatgtgttaacaactacgggtgcattgactgtgacgtggtttgagatgcatttctacgacgttgcaattctataaaaataatgataataataaaagcggtttaaacttaataaaagcacataagacacaacatgtatttaaatcagatatttagccattataacaatttaagcgaccgtgctagaaccacgggattcgagggtgcctaacaccttccctcgggtcaacagaattccttacttagaatttctggttcgcagacttcatttggaaaagtcgaaaatttcctcgatttgggattcaagataaaccggtgacttgggacaccaaaaaccaaacctttcccaagtgacgactctgaattaaataaataatcccatttcgaatattgtcacttaaattggaaaaactccacccgcgcatcttacccctcggggcgggcgcgcaaaaaggaggtgtgacaatggcctggcagtatccaaattgctgctcaggtctgaacctgatcctcaatggatcttaactcccaaaatgtggcctagtagactggttagggtgtgccagcactccttattgttgggtatgaccaccagtttacgctggacttcccctaattcccctctattgcgcttgcacttactcttagcctctaagttcttccccccccccctcctatgagccttgccttgggactttgagttccttctaagcttggacatttgagggttggcccttccacactacactataatctgattctgtaatgatatttgggggtgtaagcattgcctggagttcttgaagctccttggaactttgacacatcccaaataagagaaaggctttggaaatctgatctttggaagttggtttatttcatatttcagacctggggtctgaattaggctctccttggttgaaatctttaatttctggtatatttcttatctttttcttattcattctggattgtaataaactgctggggtgttcgtgaaaagggagggtcagtcctgcatgcaaaggggtagataccatgttcatagggaattactatacttctgaaattctgcatctcatgtagataccatgttcatagggaattactatacttctgaaattctgcatctcatgtagataccatgtccatagggaattcctatacttctgaaattctgcatttcatgtagataccatgttcataggtttttctgcacttcatatagataccatgtctataagtcatttttgaaattctgcatatcatacaggtaatatgcctataggacttcttgcattttgcatatgcatctgtcactaggcaaacctgtttataagatttaaataactaactgcatatagatgaccggtcaataggatttctgcatgacaataacaacgcttaaaatcagtaacgcctagaaagcatgcctataggagctatcaaccaaacgtgaatcatcaactcgcttataagcctaaaattagtagcaataatgtttaacgcctgcagatcttatgtccctgtaattgacaattcttttttctgcaatcagtttacttctttatttctgaaactaatagatatcatgcctataggttccatttaacacctaggcaagcgttagggtaaaaactataattgcatcaatctttgataattacaaccagcaggcaggcctaatttggacatcttatatgaaaatatgtgataaatcagcctgccttaatgtttaagtttaattcagacctaatcagtacgtgtaagacatgctaaactatatgattttctctgatttaaggaggtttatttgagccatatgtgcttacttgctttcccaatacttgctgtatatgttttgaatgtcaccttagaattttatcctttttaaaaaactgcaaaagccccagctccctcccttttaggattagtagtcacatatgcctccgggactgataggattgggacgggtaatagcatgcaataagtaacgatactattccgtgctttaataccttaacggggtgggaagggtagatatggagatgatgaccgatgatttaatatcacgtgcgaccccccttctttgaggagtgattgctgggtattgcattgaagtgatccatattaatagtaaacctaggacccccctccccttatttgctttcatctcttttcttgaaaccattcaaatctttttttcataaatttttgtcccctctacttaccttcaaaagttttcaacctaattgcaatgttgtatgcaagtccttatttaagccttgattgtttacttgtaaagccacaattgtaacatggccgggaccacactagtggatcttgaggggtgcctaacaccttcccctcgagagaatttctagccgaactctgattttttccaactcaaacctttcttaaagtgtcctaatgcactataatcattaggtggcgactcttcaaaattccaaaacccaattctcgaaagggaatagagttgtcctcccaatgtcgtatacccgacttcgacccgtagaaaaaggggttgtcgacagcatggcgactatgctggggaacttctttaggattttaccattgcatgttgcttgtgactttactatctcattaattgctttatttactgtcttttattctttcactacaaaactgacttggctcttcatgtcttttctttcctttaactgctttcctttactgctttatttcaatactgttgtgattactgcaattattgtaatcatttatcttatgaacatggaaatacatgtcaatttatttcattcttgtaaactgcatattcaacatcatattccactcgtgccaaacaaagactatagcgacgcttataatgagtggttgcgctcttccaatattatcaccctttaaagttggcaaaggcgtatttgtggtaaaaccagtcgatcagtggtgcagtcgacggttccgtgcctttccctcttgagttgtccactcaaaggtacctgtctaataccccaatagaaaccttactctgtttaactgtgcatgcatcatggtcaaacctagccgagtcagttatgttgtctgcataatgactcattaagataaccttgtccaaagtccactgggtttccttgaaacccaaacggacaccaccatattctgtacatttatttggtgaactaaatgcttttatgctgattattggtattaaatagtcgagtccggtgggggtgaggtcttaacccttttgttttgcagaaaatgaatgacaaagttcctgacttcggtatggtaaacataccttcactcttgcagacttggtggagaaacctcccaccgagcaaccaaatcaacgaatggaaagatagagtcaccaaggctagtgagaagctagaatacccggagtacagcttgctggaattggaagggaaagtgaggaaaagagtcatcgactgtcaaaatgttgaggaaggcaaaggagaacgtctggcgatagcatttttactggaaaatctgcgtgagctggaggacttgatcaacaagaacattcaacctgaagaatgtccttctaggaccaagtagttaggagtctttcttttcgcttttaatgtaataaggccaatggtcattagtgacatttttactttccgctattttagtgtcgttttgggattcgtcttatttttgtcaataaaatgaggcatttagcattataagttctccaaattaacttgtcgctaggcctacttcgggcacaacgaggcacccaaattaggacatgatttatattcttgcacaatatgtttaaatattgcaacattttttcttcataatccgcactaacttgttaccttttttgtttttattttcttttattattcccctcccaaaggttagttcgtgcattatggcaccatcatcatatagtacaagatccaagggccctccacctcctcctcctccaagtcctatccggaacaagaacaaaggtagaatgggagattcaagctccagaaaggaaattgaaagaattgagattcctcaggataccccgatttctaaggaaactgctgcccaacttgagcagaaattattgaagtttcgagaagaactggaccaagttcgaaacttgtcaaatttatcattctctctcactgatcctgatgtcaactttccaaatgctcaaaatcccgtacctccacagaacaccccataaccacagatgcagcctactcatgctcaacactgcaacacatgccacactccaaacaatactccactactcattcctgaaccactgaacaccacaaacgaccacctccacaacactcccatctacgtagataccataccccactacactcaaccaatcccaagtgcacctgagtctgatgacaaggactctcttatcagaaacatggcagcagaactcaagaagttgatcagtcgagtccagggcatggaaggaaacaaaggtatagaggggatgaattatgaggacctctgcattcagccagatgttgaacttccggaggggtacaaacctcccaagctcgaaatgttcgatggcacgggagataccagagtccatttgaggacatattgtgataagttggtcggagtctgaaggaatgagaaaatccgtatgaaactcttcatgagaagtctgaagggggatgctttatcctggtacatcaatcaggaccctaagaaatggacaagctgggtaggtatggcatcagatttcatcgataggttctgattcaatatagagaatgcaccggatgtattctacatccagaatttgaagaagaagcctaccgagacattccgcgagtattttactcgttggagatcagaggctgctaaggtcagaccggctttagaagaggaacagatgaacagattcttcgtccgggatcaggatccacaatattatgagaggttgatgctgatcgagggccagaaattctccgatatcatcaagctgggggaaagaattgaggaaggcattaagaatggtatggttactaatcttgaagcattgcaggccaccaacaaggctttacagtctggtggcacgtctaagaagaaggatgtgagtgccgtgatggtcgcacagggatccaaatcaccactaaaataccacacttactcgtcacctccacttacatatcagcctatcccgaattaccaagtacccccaccctcttaccaaaatccaccacccgtttaccaatcatctccacctcccacatatcaacccatttcacccagatactctcaacctgcacctgtttaccaagattataatgcccaaccctctcactaccaatcacctcccactcgccaaaatttccctagacccagaccaaattttgaccgcagacctcccagataatatacagctatcgctgagccaattgaccagctgtatgagaaacttaaagctactggttacgtctcccctatccctgccataactttagaaaatccttcacagtgggtcaaccctaataacatctgtgtgtaccactccagcatgaagggacataccattgatgagtgtcgctcattgaaggacaagattcaaactctgaccgccaataaggttatcgtagcaaaggagcctgctcctaatgtccgcaacaaccctctgcctgatcacaaaggtggagacattcacatgatcgagatcgaagatgactgggaccccaaggggtcgataggattgattgctgagggcgatgagccaaagaaaccagcggtcatgcttaacccaattgttgtgcagaatcagccctccaagggagatgaagtaaatatgtttatacctctcgaatttgaagcaccttcttctgcaaaggcgcccagaccaattaaggttgagtttggagtcccgaaggcacctgcacctttcgaagttgctgtgttaccaccaagggtacctattcctatagcaatgtcagacataacaccgttccactcaaatgccataccatggtattacacagctgaagcaagaaggaaagggaagaccaagatgggagaagcaattgctgcgcagggtatgaccagaacaggtagggtttacactccagagcacctagttgagtccagtaagcaagcctctggacggactactgaaactgggcccaatgatctttggaggaaaatacaagctaaggagtattcggtcgttgagcagttgaacaaaacacaagcgcagatctccatcctagctcttctgcagagctctgacgcacacaaaaatgccttgatgaagatattgagtgaagcttatgtgcccagcaacataactggaggcgaaatggaaaatatggtagggcaaatactggaaagccacaaaatcaccttccacgaagatgagctgccaccggaaggactgagtcacaacaaggccctgcacatcaccgtgcaatgtgaggattacttcatcactagagtcctgatcgacggaggatccaacctcaacatctgtccgctgatcactctcagaacattgggaaagagtctgcacgagattaaagatggagccattaatgtcaaagccttcgatgggtcccaaaggtctactattggagatattagcctatgcctgcaaatgggaccaacttggttcgacgttgactttcaagtgatagatgtcccagcatcctacaacttgctgttgggacgaccatggatccacgccgttggagctatagcatcgaccctgcatcaggcagtgaagttcaaatggaatcaccaagaggttattattcatggcgatggtagcaaccccatatatagtcgccagaccatcccgatgattggaggcagaaggagaataggcggagaaacataccaccacattgaaagggtcaacgctgtagacaaggataaatggtgggataacaagattaaaagtatcttgaattggtgtgggtacgaacctggaaagggactcggcaaaaacctccagggaatcaccaaacccatcaagctgaagaaacatggtactacatttggtttggggtatgaatacacttggaaggagttcaatgactggtcgccaccatggcacggtccctactatccactggagcatccgataccttgcctggagcagactttccagccgacagacatcatatatggatcagaggaagatgaagcattggcagccatgaagaatctatttctggaagatgatgatatggactgctctgttattttcgaggaggaaggggaggaagacccttctatacaagctgtgaaccaaggagaacgcctcagcaattggtcaatcagaaccaccagggcccgaaaaccttcggggtagcaaggctaaactaaagcaccatgcatcacatttttactttttactagctgattttatttccgcattgtctttaattttgaaaagagctctgatattcaaaacaattatgaattcaatcaaagcattttagtttattatatatctcgctcttattattttttctatcattcactttattttacacaacattactattacttgccttaacgatgaaccaacgattgtgacttgcaatgagataacgcaacaaacagatatggattcagaagaggatgatataccagaagaggtcatcatagaggttgagaattttgagaatagtcctaagtctaacttggatgaaactgaggtcgttaatctgggagatacagagaatgtcaaagaaacgcgcatcagtgttcacctgtcaccatcagaaaagaaagagtacacggaattcctaaaggaatatgaagacatatttacctagtcgtatgatgatatgactagtctcagtacatccattgttgctcacaaactgccaacagatccaacatgtccgccggtaaagcagaagctcaggaaattcaaacccgacatgagtttgaaaatcaaagaagaggttaccaagaaagtcaaagctaggttctcagggtagtagagtatccaacatggttagccaacatcgtgccagtgccaaaaaaggatgggaaagttagagtttgtgttgactatcaggatcttaaccgggccagtcctaaagacgacttccccttgccaaacatacacattctaattgacaactgcaccaagcatgagttacagtctttcgttgattgtttcgctgggtatcatcagatatggatggacgaggaagatgcagagaaaacggcaaataatgccattcggtttgaagaatgtcggtgccacctacatgagagccatgactaccatatttcatgacatgatacacaaggagatcgaggtatatgtggatgacatcatcatcaaatccaagaaatcaagggatcacatggaagacctaagaaagttcttcaacagactgaggaggtacaatttgaaaacgaatcccgccaagtgtgcattcgggttcctgctggtaaattattgggtttcatcatgagtcgtcgaggaatagaattggatccgtcaaaggtcaaagctatccaagaattgccaccgccaaagaacaagaaggacgtgatgagtttcctagggagactcaactatatcagccggttcatagctcagtccacggtcatttgtgaacctatatttaaaatgttgaaaaaggacgctgccaccaagtggactgatgattgtcagaaagctttgacagaattaaggaatacctattaatgctgccggtcttggttccgcctgagccaggaagacccctattactttaccttgcggtattggatggagtatttggttgtgttctgggacaacatgatgaaacaagtagaaaggagaaagccaactactatctcagtaagaagttcacaccgtacgaggcccgatattctcttttagaatgcacttgttgtgctctgacttgggtcgcgcagaagttgaggcattacttctgtgcttacactacttatctcatatccaaaatggaccctttgaagtgtatcttccagaaacccacgcccactgacaagctcgccaagtggcaaatcctgctacgtgaattcgacattatttatgtgatccagaaagcaatcaaagggcaagccttggcggatcatctcgccgagaatctcgtggacggagaatacgagcccctaaaagcgtatttttctgataaagaggtatctttcataggagaagatattgcagaatcctatgatggttggaggttgtttttcgacggagctgcaaatttcaaaggagttggcataggagcagtcctagtatcagaaaccggccagcactacccagtatccgccaagctcaggttcccgtgcatcaataatatggccgaatatgaagcctgcatcttggggctcaaaatggccattgacatgaacgttcaggagttgctagtgatcggggattcagacttgctcatacatcaggttcgagaagagtggacaaccaagaactctaagatacttccctacttgcatcacatacaggagttgaggaaaaggttcacaaagacagaatttcagcacgtccccaaagtccagaacgagtttgctgatgcattagctactttatcatccatgatccagcatccagatataaatttcattgatcccatcccagtaaagattcatgatcagctagcttattgcgcccatgttgaggaagaagcggatggaaaaccatggttccatgacatcaaggagtacttgacaacaggggaatatccagaacttgccaacgctactcagaagcgcacacttcgtaggttatccagcaacttctttcacagtggaggaatcctgtacaggactcccgatttgggtttactaaggtgtgtcgaagcaaaagaagcatccaggctattggacgaagtgcatgcagggacctgcgggcagcacatgaatggttttgtcttagcaaagaagatactccaagtaaggtatttttggatgactatggaaacagattgtatccggtatgttcgcaaatgccatcactgtcagatacattaatatatgataaaggtgcctccaaacgggcttactgcaacaagctcaccatggccattcgccacttgtggaatggatgttatcagacctatcaagcctgccgcatcaaatgggcacaggttcatcttagtggcaatcgattattttaccaaatgggtcgaagcagcatcatacaaggcggtcactaagaaggttgtgacagatttcgtctgcgaccacattatttgtcggttcggaattccgcaatcaatcatcaccgataatggttccaatcttaacagcgacttgatgaaagcaatatgtgaaacattcaagatcaaacacaagaactctatagcctacaatccttagatgaatggagttgtggaggcagccaacaagaatatcaagaagatactaaggaagatagtcgaaaggcacaaacaatggcatgagaaattatcattcgccttatttggataccttaccacagtccgcacatcgaccggagcaactccctacatgctgatttggtacagaggcggtcatccccgccgaggtagaaattccctccttaaggatcatacaagaagcagagttggatgatgcaaaataggtaaaaggtcgctacgagcagttagcccttatagatgggaaaaggatgaatgtagtttgccacggtcagttgtatcagaacagaatgtccagagccttcaacaaaagagttaagccaaggaagtttgcaccagggcagctagtgttgaagaaaatattcccacatcaagatgaagccaaggggaagttctctcccagttggtagggtccgtaaatggttcaccgggttctaactagaggagcccttattcttgcagagatggatggagaagtctggccgaagccagtcaattcagatgcagtgaaacgatattatgtgtaacacttatgattccctttatgatgtaatttgaactacgcctgacctgattcccgtttaagaggggatacgtaggcaaccctatgggttcggtcacaatttaataaaaattccatttttccccgttattggaactggggcagaattttgaggaggacccttaaaattccgaagttgattttagcccatgcatcaccagaagccccagctcagtaaactggggtagaattttgaggaggaccctcaaaattccgaagacgatttgtttagtcattcagcacagccgtcagaaatgtccgcccagcaaattggggcagaattttgaggaggaccatcaaaattccggagcgaaagaggttgcaatgtcttgaaccacgtcgcagtcgttggttcatctaaagaaaactattttcgattatatacttacgttatatttactaaatcatgcataactattatccgaattgctgttgattagcgacgctaccccaatgacacacaacgtcaagagcccggggaagacgaactaaccttttccccttacagaactcacgatttttctttggatgcatgcactcgacttgtagtatcgttaagtatatttatgtatgcatactttcccaagaatgcaacttctcagaatcatcacttgcctgcaattgctatctgtacacaatttctcaggcagtcatattgtcataatcggctatcagctaagagatcttactattaatcatccttttacattctttcactgcataaggctacttatttgcctttcgagactaagttttgtctccatctgtattttgcataaggctacttttctgccttctgaggttaagctctacctccatcatcatctgcataaggctacttatttgcctttcgagactaagctttgtctccatctgcattttgcataaggctacttttttgccttccaaggttaagctctacctccatcatcatctgcataaggctacttatctacctttcgagactaagccctgtgtccatctgcattttgcataaggctacttttttgcctttcgaggttaagctctacctccatcatcatctgtataaggctacttttctaccttccgaggttaagctatacctccatcatcatctgcataaggctacttatctgcctttcgagactaagacctctctccatctgcattttgcataaggctacttttctgccttccgaggttaagctctacctccatcatcatctacataaggctactcttctgcctttcaagactaagccctgtttccatctgcattttgcataaggctacttttctgccttccgaggttaagctctacctccatcatcatctgcataaggctactatctgcctttcaagactaagccctgtctccatctgcataaggctactctatctgcgttttgagactaagcattatctccatcctgcatggctgaaatatcgcctctttacttttctcgcacggctgcaacatcgccaccttcatttaaattttgtaccggctgaaagatcgccaacctattcaaaggcatcatagttcggaggcaccatctacatggcccgataacattatttcatggcctgcgaatttttatttacgctcttcatagcccgggacgtcatggtccaaggacgtcatcctaaccgtccaaagacaacattcatggtccaatgagaacttgcatcacgtttaaatttatgtacaatctatgttgtatttcccacttgcaggtacaccggctagcaaacggccgtctcagtggtagcgatcccgctccggttcttgcagcctatcagacttcaactatccttctcaacttaggcatcgcgtccgttcctttcaataactctatcggcatatttcgtcgatggatcctgaactacatatggcctgattcctgtaagaccagggatatgtaggcagctcaagagccagagctaagtcagaattctttgcaaatcgtctctttcagtcaaaattggccatcatatctttacccgacaactctttcatccttgccgggtaaagaggggcagctgttgatacccaatttttccctataaatttcttttacatgcaaatactttcaaatatcatatacatacatatataagtatgcccaagtgttttagcatttttccaaatttttaagagatttttaaattgatttattgctcaataattattcccaaaattatcactttggtgaataacttattttattctcatatttataccaaaatataggtaggttacttttcatatatttttacaaattaatttggtattttaaaagctaaattgcatataattgcaattttagcctgttttaagatttaatagcattttataattatgaaaatggttccaatatttttcaattaatatttgtatactattaacggatccagtgcttttaatttgccttcaaaatcattttttattatttttataaaataaaaagggaaaactggctatttaaattttggcctcagttcgtttcaattgtagccccattacatttcgattttagcctaaaattgacccaatttcaaactcaaattcggaacagcccaattgcttttgacccaacccctaacccaactcaaacgacccaacccggttcctcacctaccttcttaaatctaggtcgttgatcatttggatcaacggccactattcgccctacaataattaaacacaggtggctaccctaatccctcattctcacttggcctgccgactttgaatcccaaaccctctcaaatcctctcaaaaactctccgaaaccctagcctcctcctacccccttttcaaccaccggtcaccggaatccatggcttctcagaccatggatagttggtactcacctatcttcactagtaagccagggttgttcgaaactttgaggcttgacctcgacgattccctctccgatcttctccgatcttctcagtcctttgatttcatggctcctccggccatgctccggcatattcaagacttaggagcctgattcttgacctctccgactcaagatcggacctgtttccaagcctttctcatttctagggtttctccgaaaccctaagctattcaaggtcctttcaccgttatttgcttagatctatactgtatctatgcttttcttgccatctaaagtgttttccccaaaggtttcttttcaaaattgtttctcttcgattttagggtttccaaaagttttacccttattatgttactttgtaaaaggttttaatcaaattctttccgtaattgtcttatgcccgttcgaaatcagaatcccttaaccaaagggagactttatgtgattggttgcaaactattttcttaccttttcttacttgttttctgcactataaaaggggactacccttctacacttgaacacactttgaattgcatactcttacacacacactctcaattacaatactcattcaattatctactctcttctgagatcttttgtactgcttgcttgcaatttggcttacaagacttatgctttcacttatttgtttccctgaaactggtatgtcctaattttgattccagcatcatccctatgtgtttactttacagttgctatgctcttggctactttcctgttcatgttctgtattgaatatgctaccctctctttgcatctgctatttgttgtgaattccccatacccctactcccttttatgtgtttgagttaaggtttatggcctggcagtatccaaattgctgctcaggtttgaacctgatcctcaatggatcttaactcccaaaatgtggcctagtagactggttagggtgtgccagcactccttattattgggtatgaccaccagtttacgctggacttcccctaattcccctctactgcacttgcacttactcttagcctctaagttctgccccccctcctatgagccttgccttgggactttgagttccctctaagcttggacatttgagggctggcccttctacactacactataatttgattctgcaatgatatttgggggtgtaagcattgcctggagttcttgaagctccttggaactttgactcatcccaaataagagaaaggcttttgaaatctgatctttggaagttggtttatttcatatttcagacctggggtctgaattaggctctccttggttggaatctttaatttctggtatatttcttatctttttcttattcattctggtttgtaataaactgttggggtgttcgtgaaaagggagggtcagtcctgcatgcaaaggggtagataccatgttcatagggaattactatacttctgaaattctgcatctcatgtagataccatgttcatagggaattactatacttctgaaattctgcatctcatgtagataccatgttcatagggaattcctatatttctgaaattctgcatttcatgtagataccatgttcatagctttttctgcacttcatatagataccatgtctataagtcgtttttgaaattctctatatcatataggtaatatgcctataggacttcctacattttgcatatgcatctatcactaggcaaacctgtttataagatttaaataactaactgcatatagatgacctgcctataggatttctgcatgacaataacaacgcttaaaatcactaacgcctagaaagcatgcatataggagctatcaaccaaacctgaatcgtcaactcgcttataagcctaaaatcagtagcaataatgtttaacgcctgcagatcttatgtccatgtaattgacaattcttttttctgcaatcagtttacttttttatttctgaaactaataggtatcaagcctataggttccgtttaacacctaggcaagcgttagggtaaaaactataattgcatcagtctttgataattacaaccagcaagtaggcctaatttggacttcttatctgaaaatacgtgataaatcagcttgccttaatgtttaagtttaattcagacctaattagtacgtgtaagacatgctaaactatatgattttctctgatttaaggaggtttatttgagccatatctgcttacttgctttcccaatacttgctgtatatgttttgaatgtcgccttagaattttatcctttttaaaaaactgcaaaagccccagctccctcccttttaggattagtagtcccatatgcctctggggctgataggattgggatgggtaatagcatgcaataagtaacgatactattccgcgctttaataccttaacggggtgggaagggtagatatggagatgatgaccgatgcgctaatatcacgtgcgacccctcttttttgaggactgattgctgggtattgcattgaagtgatccatattaatagtaaacctaggacccccctccccttattttctttcatttcttctcgtgaaaccattcaaatctttttttcacaaatatttgtcctctctatctaccttcaaaagttttcaacctaattgcaatgttgtatgcaagtcattattaagccttgattgtttacttataaagtcacaattgtaacatggtcgggcccacgctagtgcatcttgaggggtgcctaacaccttcccctcgagataatttctagcccttaccggaactctggttttttccaactcatacctttcttaaagtgtcctaatgcactataatcattaggtggcgactcttcaaaattcccaaacccaattcttgaaagggaatagagttgtcctcccaatgtcgtaacccgacttcgacccgtagaaaaagggggcgtcgacagcatggcgactctgctggggaacttctttaggcttttaccattgcatgttgcttgtgactttactatctcattgctttatatattgtcttttattctttcactacgaaactgacttggctcttcatgtcttttctttcctttaactgctttcctttactactttatttcaatactattgtgattactgcaattattgtaatcatttatcttatgaacgtggaaatacatgtcaatttgtttcattcttgtgaactgcatcttcaacatcatattccactcgtgccaaacaaataccatagcgatgcttataatgagtggttgcgctcttccaatattatcaccctttaaagttggcaaaggtgtatttgcggtaaaaccagtcgatcagcggtgcagtcgacggttccgtgcctttccctcttgagttgtccgctcaagggtacctgtctaataccctaatagaaaccttactatgtttaactgtgcatgcatcatggtcaaacctagccgagtcagttatgttgtccgcataatgactcattaagataaccttgtccaaagtcctctgggtttccttgaaacccaaatggacaccaccatattctgtacatttatttggagaactaaatgcttttatgttgattattggtattaaatagtcgagtccggtgggggtgaggtcttaacccttttgttttgcagaaaaatggatgaaaaagttcctgacttcggtatggtaaacataccttcactcttgcagacttggtggagaaacctcccaccgagcagccaaatcaacgaatggaaagagagagtcaccaaggctagtgagaagctagaatacctagagtacaacttgcttttgcaatatttgatattattgagtcaattgtggctagatatgagtggtttggaggcagattagaggggaaaggccccggtagagttctgaattgattgtggagtgaggtaagtgttgagcttaaccttaacttgagggaattaggaacccttagactatgtgctatatgaatttcatgtgttgcagtgtatattggattggcctgccaagacggtgaccttagtcttgctagggttgcctcgattagagtggagagggattcctagctattttaccagcatggttatctcttatgtgaaggctcggcttatggttgagacggggtgtttagcttatttggcttatattcgcggttctagtgtgaaaattccttccatggatttagtacttgttgtttatgagtttccaaaggtgtgtcctgcagatctgcaggggatgccactcgacataaacattgacttctgtcttgatttggctacgggcacccaacatatttctattctgccataccttatggccccgctagagtttaaagaaatgaaggagaaattgcaagatttacttgagaaaggcttcattagacctagtgtctcaccctagggtgtgtatgtgttgttcttgaagaagaagaatggatcgatgaggatgtgcatagattatcggcagttgaacaaagtcaccatcaagaacaagtatccattgccaaggattgatgacttatttgatcaacttcagggtgccaaggtgttttcaaagattcatttgaggtctggctaccatcagttgaggattagggcatccgatgtccctaagacaacttttcagatttgatatgggcattatgagtttctagtgatgtcatttggtttgacaaattccctagcatcatttatggatttgatgaaccgggtgttcatgccctatttggattcctttgtgattatgtttattgatgatatcttgatttactcccgtagttgagaggagcatgagcgacatcttcggattgtacttcaaactcaaagagacaaccaattatatgctaagttttcaaaatgtgagggtttcttggggcacgtagtatcgacagagggcattcagttggatcctaagaagattgaggcagttcagaactggcctagacccatttcagctacggagatccgaagtttcttgggtttggcgggctattaccgtcagttcgtggaggggttttcatctatagaagccccattgaccaggttgacccagaagggttccccctttaaatggtcagacgagtgtgaggcgaacttttagaagctcaagactgctttgacaacgacgccaatgttggtgttgcctacaggttcaggatcttacacggtatattctgatgcatctagtattggacttagtgcggtattgatgcaggatgacaaggtgattgcatatgcatcacgaaagctgaaggttcatgagaagaactaccatgttcatgacttagagttggcagtcattattcatgcaccgaagatttagaggtactatctttacggtgtgtcgtgtgaggtattcatggatcatcggagcttgcagcattttttcaaacaaaaggatatcaatttgaggcaggggaggtggttagagctattgaaagactataatatcaccatcttgtattatccctggaaggtcaatgtagtggctgatgccttgagtagaaaggtagtgagtatgggcagccttgcgtacattccagtcggtgagagaccgcttgcatcagatgttaaggacttgaccaatcaattcgtgagtttggatgtttcagagcccaatcatgttatagcttgtacagtcgctcgatcttcattgtttgagtgcattggggagcggcagtatgatgaccctcatctgcttgtctttagagacacaatgcaacatggaggtgctaagcaggttactataggagatgatggatttttgaggatgcagggttgtgtttgtgtgcccaatatagatggacttcatgagtacattcttgaagaggcctaaatttccctgtattttattcatccggatgcagccaagatgtatcaggacttgcggtagcattattggtagaggaggatgaagaaggatatagttgcatatgtagctcggtgtctaaattgtcagcaagtaaagtatgagcatatatttggtggtttgctttagaagatagagattcctgagtggaagtgggaacgtatcactatggattttgttgttggactcctatggactcagagaaagtttgatgcggtatgagtcattatggataggctgatcaagttagtgtatttcattcctgtggcagttacctattattcagagtggttggctgagatttacatctgcgagatcgtttgtcttcacggcgtgcccatatttatcatttttgatctaggtacggagttcaccttgcatttttggagggcagtacaatgtgagttaggcacacaggttgagttgagcacaacatttcatcctcagacggacggacagtccgaacgcactattcagatattggaggagatgttttgcgcttgtgttatagacttcggaggttcttgggatcatttctttccacttgtggaatttgcctacaacaacagctaccaatcgagcatttagatggatccctatgaggtattatagggatctaggtacggagttccctatgaggtatttagatgggtaactgccactgcctgtggcagttacctattattcagagtggttggctgagatttacatctgcgagatcgtttgtcttcacggcgtgcctatatttatcatttttgatctaggtacggagttcaccttgcatttttggagggcagtacaatgtgagttaggcacacaggttgagttgagcacaacatttcatcctcagacggacggacagtccgaacgcactattcagatattggaggagatgttttgcgcttgtgttatagacttcggaggttcttgggatcatttctttccacttgtggaatttgcctacaacaacagctaccaatcgagcatttagatggatccctatgaggtattatatggcaggcggtaccgtttgccagttgggtggttcgagccggtggaggctcggttgttgggtacagattcagtataggatgccttggataaggtcaagattattaatgattgacttcacacagcttagtctaggcagaagaattataccaaccataaggttcgtgatgttgcctttatggtcggagagagggtattgctcgaggttccacccatgaagggtgtgatgaggttcggaaagaagggcaagttgagacctaggtatatcggaccttttgaaattcttgagagagcgggagaggtggattacaggcttgcattaccacctagattatcagtagtccatccgacgttccatgtgtccatgctccggaaataccacggtgatccgtcccatatgctagatttcagctcaatacagttggacaaggatttggcttatgaggagaagccggtggctattctagcccaacaggttcgacagttgaggtcaaagagttatccttcagtttgagtgcaatggagaggccagttggttgaggcatctacttgggagtccgagtcggacatgcacagtagatatccacaccttttcaccagccaagtacttttctaagtccattcgaagacgaatggttgttttagaggtagagaatgtgatcacccaataaacatctaaagttttaaaacctaattctgtgtttccaagcctctaatagcttctttaagccttcctcaatttgcgtgcgcagtccaggaatttttttgaaaggcttttatgttaaaaattgataaaatatgaaagtttaccataaaattttatttgagttgacttcggttaacattttgagaaaacaaacccggatctgtattttgacagtcccggtgggtccgtatcgtaatttgggactcggcgtatgcccaaaatcaaattaggaggtccttagctcgagttattgatttttgtcgaaaatcgaaagtttaaaggtttaaggatttttaagaattgacagatgtttgattttgttgatatccgtattttggttccagggcccggtataggtccattactatatttatgacttgtctgtcaaatttgataagaaacagagttagtttgaggtgattcggacgttcagttgttaaaatagaagttttaaagtttttttgaaaatttcatttgatttggagtctgatttttagttctaggcatcatgttggtattttgatcgcacgagcaagttcgtatgaggtttttggacttgtgtgcataatttgtttggagccccgagggctcgggtgaatttcggataggctacggatggttttaaacttagaaaagctggtttttcctcagcttcaactgtcatctagtttccttcttagcgatcgtgaaggtaatctcgcgatcgtagaagaatgatcttggctgagtgggatttacttcatcgcgaacacgatacttgggtcgcgaacgcagagtgttgggggttttatcctccgcgaacgcgaccaacctcgcgtgaatgcatagctttagggacctgggggaggggagctgactttacccttcgcgaatgcggaacatggctcgcgaacgcgtaggttggtgggtgtaagcgtttgcaaacgcgaagggtatctcgcgaacgcttaggtctttgggccactgccttccgcgatcgcgtcaggccctttgtgaatgcaaagaaggcctgacacacagtgatttaaacatttcaaaaatgaaatttctcccatttttcataacccttccgttagagctcggcctaggagtgattttgaagagaaaactcaacatcaattcataggtttgtacactttaactcattttcttccatttctaacataatccattaattcctagccctaatctttgttcttccatgatagaaaactagggatttaggaagaattggggttttttgtaaatttggaatttagtcctcaatctgaggccggattccgaaattaattacataattgggctcggcggtgaatggattttggtccgaacctctggttttgaccaagcgggcccagggtctatttttgactttttggagaaaagtttgaaaattctaaatttatgcattgtaattgattccttttgcaatatttgatattattgagtcaattgtggctagatacaagtggtttagaggcagattcttggggaaaggccccggtagagctctgaattgactacagagtgaggtaagtgttgagcttaaccttcacttgagggaattaggaccctcggactatgtgctatgtaaatttcatatgttgcggcatatatgtgaggtgacgagtgcttatacgtcgccgaattacttgttttccctgattttctgcttttccttaattatctccttccctgtcttaaattttatatgctctagatacctatcatgcttaattgctacttgttaatcagtgtttccttctgttaatattgttagatcctttcatattttcatgatttgccttaacttacttacttgcaccttctaattgtcatttaccggattaacttgctgtgtagtatcacctatatgaatttctgtgttgtacaaggtttcttttttgattcagcttggtatttattgatcgtaaaggttcttgcgatttgaattattgatttgactatgcacatagagtatttggtactaatatggtgggatcgggttgcaagccgcaacaggtgaaataaggatggattgatatggtgaaataagggtgaatttgtactgatatggtaggatcaagatgcacgccgcaacaagtggaataagggtggattgatacggtgaataagggtgaattatgtgggatcgggtttcgcgccacaacacacacacacacacacacacacacacacacacacacacacacacacacacacacacacacacatatatatatatatatatatatatatatatatatatatatatatatatatatatatatatatatatatatatgtgtgtgtgtgtgtgtgtgtgtgtgtgtgtgtataatttactattgttgatattgttacagtaaaataagggaggattctgtgttgtacggtgggatcaggttgcacaccacaatagccaacgtgtttctatttccttaagttgtgttggttttctgtattttcacttgaaactatatggtttggtaattctgatcgtcaattgcttaattcttgagattttagctattatcttcagttcgctgtcatattttgttccgtatttccttttctgcctttattatatattgcgtacaagttttagtgtaggtgacctgccttagcctcgtcactacttcctcgaggttagtctcgacacttacagagtacatagggtcggttgtactcatactacattctacacttcttgtgcagattttggagtcggtcctagcggtggttattagcgtgctcagattgaacagcttgtggagatttgaggtacaactactcagtgtccatagctcttagaatgcctttccctttttatttggttgtgtagtttcttttcagacaactttatgttatttcaaactcttgtatgtatgcgctcatgacaccaggtccgtagttgcatcagacatttggttgttttagcttctgcatttttactttggattatcgtagttattttagttccttctcattaattaatttaaactattaaaaatggataaaatgttctaatgttggctttcctagaaagttgaatgttaggcgccatcagggccccgacgatggaaattccggattgtgacagagagagcctacgtatttgatgcaaacctatcactactagcgttggagatcaaaattaaaaaaaagggtatacgtttggtccatttaaccaattttgaattaagagggtgcttggctaagcttataagctggtcaaactagcttataagcacttttcggcttatctatgcatttagtaaagttaaaagagcttataagccaagggtaacgacccgactggtcgttttgcttttcagaaccctgttcccttaaataaaactttctgtgcttgctttaactaatttacgacctacggggatggttggtccaagatttggaagagtttgggttgaaatatgctcatttgattccttaaaattttcttaaaaggctaagtttgactttggtcaatatttttagcaaaaggacctggattagtattttgacggtcctggagagtccgtaagaaaatatgggacctgggcatatgcccgggatcgaatcctgaggtccctagcccgagtaatgaaattttattagaaattgttaaactgaaattttaagtatttaaagaaactaattaatgattgatcatcttggtatcgggctcgtatattggtttcggagcctagtacaggtctaatataacatttaagacctacccgcaaaacttggtgtcaatctgagtagtataagtacgttagaagtgaatttaagaacttgaagttcataagtgtgattcaattggttttaggaggtgattcatagatttagcattgtttcgggtgttccgaaggttcgagcgggtctatttcatgatttcagacttgtcggtatgttcgggcggggctcgaaagccccgagcatcaatcggacgaggctcgagtgaagttggaaaagttgcaaagggctgaagcatctggtatctgtcataaccgtacctgcggttggacggccgcaggtgtaagactgcagaagcggttgccctctcgcagatgcggccaaggcaggatagtccagaaaccgtagaagcggctccatagaagcgacttcaagaccgcagaagtggtcccagcccgcttggcccttctgcagatgcgacctcttcctcgcagaagcaggaccgcagatgcggtcccctaactgcagaagtggaaatcgctaaagcagtgagcttcatttaatacgggtcctaagtcatttttgccacttttcactcctcctttgggcgattttggagcttcgtagagaaaacttccacctagcaccttgaggtaagtttatcccacctattcctagtttaatatttgtgtcttaggtagattaaacactaggattaatgtaaaatcatggggttagagcaaaacctaaggttttgacaaaagttggatttgaccacaaaatttgctatgaaatgaattagaaatcatatattattgatccttaagttatagagaacaaatttcttcgaaaaatttcggaatccgggcaagtgggcctggggtcagattttaggaaactagtgttaagggttggaaaattgcttaaatagctagaatacgatcttgtgagcttatattgactagttcctacctcattttactagctttggatcagtcggctccaaattgagagtttgggctcgtttttggcattgggaagtatacattggagcgaggtaagcctcctttctaaccttataagagggaattgtccccataggtgtaataattgaataaattgctactatatgcggggcctacatacgcactaggtgacgagagtccgtgcgtagctactattatgctatgtccgggtagtctaggacccaaaagcatgctctatgtgatattcttgtaacttcatgtttaattcggatttgtataaatcatgttgattggggtaaatcagactagtaagaggaacattatctttcttgaccttttaaagagaaattgattatttttgtgagtaactgtttcccagatatacactattgtcttcttgttgttgtgttatttatatttgaccgcgttgcatgtttgattcacgagcgggataatagatgcatctatggttcgtgtcgttcaaccctcgatagtgcataatttacttttttgttggttcgggccgtatgaccttcgacattacttgcgcatgttttacttagtatttttctatggactgaacttcgtatatgtcttggaattcaaatggttaactatgatataatcaagaaaaaggaaccgttatttcttgccatgaaatgctatttaagtgtactatccatgcttagtataaattctttctcatattatttgaccctagtaagtatcaagtcaacctatagtctctacttcttcaagattagacaggatacttaccaggtacatattctttatgtactgatactacacttaggctggtttatttccagcggatccagcaacatcgcaggcaggagggggagcacagagccctactgcttaggcccctggacatgcagctgtagtatatcagactcctcttggtgcactacccgcagatggggcctagccagtggctgcagtggcgccctagcccagaccagctgcggatggcgagccgcagaaattgttggatagatggaccagacttcaccctcctgtcttcgggggtgagcgtcatgaggatgcccaggacttcatagacaggtgcagggacagactgcacaacatgaggatattggagtcgcatggggttgacttcattactttttagctagagggtagggcccgtagatggtggcagtcttatgttcttggcaggctagcaggttcccctcccctcacttggggtcagttcacacagttattcttggataggtatattccaccctctgagagggaagtgctgcggtatcagtttgagcatctggagtagggttagatgtcggtgaccgattatgaggcaaggtttttttgagttgtctcgtcatgcactcatgatacttctcactgatgcacagagagtgcggagatttgttgcggggttgcaccccggtattcgagctagcatggcccgagaggtggagatgagtactgagtatcagctagtggtagagattgctcgcaggattgagggatatcgctagaggggtagagagtagattcagtaggataagaggccccgattttcgggagggttcagaagtaccctagctaggggtagaggtcacttcgggaggggtcagcccagcaggaccccgtattcaggaccaccaccacctccccgaggtgctccaatgagaccttatttcagtgcgatgctggagagttcttccgcccaccagctatttagggttcctccagtgggtattctggtcatcagggttcttccagtgcttacttcagtgccatgccaaagagttcatatcgcccaccagccattcagggttctttgggtgggtattcgagttagcaggctcagacttcagggcagcagactatggttcctaggggttgctacgagtgttgagatccaggtcacatgaagaggacctgcccagagttcggggtaaggcaatacaacagggtcagcagcccatgattccagcaccgattgcacagcctctcagaggtgggggacagatgggaagaggccgtcctagaggtagagtccaggcaaggagagttcagtcagctactgctcagtccgatagaggccagccaatcggtgctccaaccagattctatgcccttctggctaggccagatgcattggcctcagatgccgtcatcacaggtattattttcgtcagcggtagagatgtttcggtattatttgctccagggtctacttattcatatgtatcatctctgtttgctcgtttcctagttatttctcatgagcctttgggcactcctatttatgtgtccactcttgtgggtgattctgtggttgtggatcggatctaccggtcctgtgtggtcacattctatggtttcaagactagagcggatctctttttgcttgatatgattgactttgaggtcatcccgggcatggattggttatctccatatcacaccatcctagcttgtcatgccaagactgtttcattagcgattccagggttaccgaggttagagtggaagggttccatagctgatacatctagtcgggttatctctttcctaaagggtgtttggcttatctagcttatgttcaggacaccactgcagagtctccaatgattgattcagttccagtagttcgggagttcgccgatgtgtttccttctgatcttcctagcatgccaccggattgcgatattaatttctgtattgatttggccccagacacccagcctatatctattgcactgtatcgtatggctcctaaagagttgaaagagttgaaggagcagcatgaggagttgttagcaaaggggtttgttagacccagtgtattactttggggtgcactagtgttatttgtgaagatgaaggatgagactatgcagatgtgcattaattaccgccagttgaacaaagtcaccatcaagaacaagtatctgttgcctcgtatcaatgatttgtttgactagttgcagggtgctagggtgttttccaagatcgaattgaggtcagggtatcatcagttgaagattcgggaattggatgttccgaagactgcattccggactagatatggccattatgagttcctggtgatgtcctttggcttgactaatgccccaacaacattcatggacttgatgaacagggtattcaggccttgtattgatttatttgtcgtcgtcttcattgacgacatcttgatatactcacgtagcctgggggagcatgagcaacatttgagagtaatgcttcggaccttgcgagagtagaagctatatgctaagttctccaagtgtgagttttggctagagttagtggcattcttggggcatgttgtgtcgggagagggtattaaggtggatcccaagaagattgaggcagtttagagttggccacgtcctaccttagtgatcgagatcaggagtttcctggggttagcaagttattacagatgattcgtgcatgacttttcatctattgcatcacctctaactagattaacccagaaaggttatcctttccgttggtccgatgattgtgaggagagcttttagaagctcaagacagcgttgaccacgacaccagttcttgtattgccttccggttcagggatgtatacggtatattgcgacgcttagcgcattggcttgggatgtgtattgatgcaggaggggcgagttattgcatatgcttcacgtcagctgaaggtttatgataagaattatcccgtgcaagatctagagttggccgcaattgttcatgctcttaagatatgaagtcataatctgtatggggtgtcatgtgaggtttatactaatcatcacaacttacaacatttgttcaagcagagggatcttaatttgaggcagtgcagatggcttgagttactgaaggattatgacatcaccattctttatcatccgggcaaggaatgtggtcgcggatgccttaagtaggaaagcagagagtatgggtagcttggcattcattccagcaaaggagaggccactagctttagacatttagtccttggctaacagacttgtgagttggatatttccaagcccaaccgggttcttgcgtgtgtggttgcttagtcttcactattggggcagatcaaggcccgacagttcgaggatccacatttggcggttctcagagagacggtgctacagggtagtgccaatgaggtttttatcggtgaggatagtgttttgcgactccagggtcacctatgtgttcctaatattgatggtctgagggaggggattctagaggaggcacacagttcacggtattctattcatccgggtgctacgaagatgtatcgtgacttaaggcagcattattggtggctgaatataaagaaagacttagcggagtatgtattgaggtgtttgaattgccagcaggtcaaatataaacaccaaaggccgggtagcctacttcagcagatgcatatactagagtggaagtgggagcgcattactatagactccgtggttgggttgccccggactttgcggaagtttgatttagtgtgggtcattgttgacaggttgaccatgttgctccccttcattccagtggtgactacttgtacagcagagaggtatgctcagatctacattcaggagaaagtccggttgcacggtgtgcctgtttccatcatatcatatagaggccctcagttcacttcccatttttggagagttgttcagagtgagttggggacccgcatggagcttagcacaacattccacccttagacagatgggcagtcggagcggacagttcggatcttggaggacatgctcagagcatgtgtgattgattttagaggatagcgggatcaattcttacccttagcggagttcgtgtacaaaaatagctatcagtccagcatagagatggctccatacgaggctttatatggtcgacggtgtcattctcctatcgggtggtttgagcctggtgaggctaagttatacgatacagatttggtgcaggatgccttggacaaggtaaagttgatccaggagaggcttcgcacagctcagtccagatagacgagttacgcggatcagaaggcgcatgatgtatcatttatggttggcgagaaggtcctcttgaaagtctcgccaacgaagggtgttataagattcgagaagaagggcaagctgagcccaaggtttattggcccatttgaggtgttgaggcgagtcggagaggttccttacgagcttgatttagcccccagcttatcgggagttcacccagtttttcacgtgtctatgctttgaaggtatcatgccgacttgtcccatgtgttagacttcagtactattcagttggattagagtctgagttatgaggaggagccagttgccattattgatagacaggatcgccagttatgatccaagaggatttcaatggtgaacgtccagtggaagggccaaccagtcgaggaggcaacctgggagtccgaggaggacgtgcggagcagatatccacatcaattaagcacctcaggtacttttctatgtccgttcgaggacgaacgtttgtttaagaggtggagaatgtaacgtcccgactggttgttttgctttttagaaccctgttccattaaataaaactttctgttcttgatttaactaatttacgacatgcggggatggttggtttgggatttggaagagtttgggtcgaaatatgctcatttgattccttaaaattttcttaaaaggctaagtttgactttggtcaatatttttagcaaacggacccagattcgtgtttggacggtctcggaggatctgtaggaaaatatgggacctgggcatatgcccgggatcgaattccgaggtcactagcccaattaatgaaattttattagaaattgttaaactgaaattttaaggatttaaagaaactaattaatgattgatcacattagtatcgggctcgtatgttggttccggagccaagtacaggtccaatataacatttatgacctacatgcaacatttggtgtcatctgagtagtataagtacgtttaggcacgttagaagtgaatttaagaacttgaagttcataattgtaattcaattggttttaggggctgattcgtagatttatcattgtttcgggtgttctgaaggttcgagcgggtccgtttcatgatttcagacttgtcggtatattcgggcgggaccgggagccccaagcgtcaatcggacgaggctctagtgaagttgaaaaagttgcaaagggctgaagcatctggtatttatcataaccgcacatgtggttggacggccgcaggtgcgtgtcacgtctcggatttcccaccctcgagagtcgtgatgacgcctactggtgaaagctaggcaagccaagttattctaattatttaaccatttccagttttaaaccattatcagtgatgtgtaaagctgataattaatcttaaaacaaattacgaaagtctaaatacatatctacctagaatttggtgtcacagcttcataggcggtctaagaatactacatacaaagtatgaaagttaaaatatacattgtttctgaaatgagtaaaggaaacaggataaaggaacgataggaggtgatgccaaggcccgcagacacctgcaggactacctcgggtcgcttgttggactgaaggcaacaaccccactgcggtccgaagtctacaacactgggatctgtacaaaagagttcaaagtatagtataaacaaaaccgaccccatgtgctggtaagtgtcttgcctaacctcggcgaagtagtgatgatgctaggaccagactactaaataaacttgtgcagttatatcataaacagccgaaatagaagcagataattagaattaatattgggcaggggaaacatgcttcggttaataacaaataacaatagaatatcaagagaatataaagaaaccaaaatccaattactagcacggataaggaaaacaaatgcagagtttactttcatttcacatctcgttgtaggtgtgcaacccgatcccatttcatgtatctcgttgcaggcgtgcaacccgatcccatttcatatatctcgttgcaggcgtgcaatgcgatcccatttcacatatctcattgcagacatgcaacccgctctcatttcacatatctcgttgcaggcgtgtaacccgatcccatttcacatatctcgttgcaggcatgcaacccgctcccatttcatatatcttgttgcaagcgtgcaatccgctcccatttcatatatcttgttgaaggcgtgcaacccgctcccatttcatatatttccgtggcggtgtgccacccgatcccatttataaatcaataataatcacaaaagaatcccggcaagggaacaataatatcaagacaacatcccggcaagggagcaataatgataataacatcctggcaagggagcaataatgataataacatgttaagcgcaataaaccacaacggagtcataacaattacaatacaagactcatggacatgcttgacaccgacgtatagatactcatcaccatgccaatacgccatactccacaattaacacgtagcaaataagacatgactcctaatacctcaagctaaggttagaccaaacacttatctcgatgccacgaatataattcaagcctctactatcgctttacctcgtgattccaccaccaattcgctcgtatctagccacaagttacttaattacatcaataaatgctaaatgaatcaatcctaatgcatgaaaatgagttttctaaagttttacccaaaaagtcaaaatttgccctcaagaccacatggttaaaacctgaggttcgaaccaaaacccgattacccattcccccatgaacacaaatatataatttgttctgaaatcggacctcaaatcgaggtccaaatcctcaatttttgaaaaacctaggttctacccaaaacacccaatttccctaatgaaaatcattgattttgagttgaaatcaagtgaaaagatgttaaagattgaagaaattagttagaaatcacttacaatcgatttggaagagaagtcgcctttgaaaatcgccctagagagtttatgttttgagaagatatgaaaaatggttgaaaatgcatctaagttatgaacttacaagttgcaggtatcgtaattgtgatcagggttcgcaattcgaactcaggctctgctaagctcgcatttgcgaaaggactttcacatttgcgaagtcgcttttgcgataaatttgtcgcatttgcgacgactggggagttcagtgcatcttcacatttgcgaagggactttcgcatttgcggaatcgcttttgcgataaagtcgtcgcatttgcgacccaaggcagcccaggacacttgtcgcatttgcgagccaggcctgaagcataccagataaaatttgcaacatcctaagtccaaattctaatctgtggcctatccaaaactcactcgagccttcggggctccaaaccaaacatgcacaccaacctaaaaacataatatggactcgctcgtgcattcaaatcaacaaaatatatcaacaactatgaatttagcatcaaaatcatgaaatttcttaagaacttcaaatttttccaattttctcaaatacgatccgattcacgtcatctcaagtccgtttattgccaaatttcacagacttatcttatatcacatataaaacctgtaccgggttctggaaccaaaatacgggcccgataccatcaagttctaaacacgtatcatttccaaaaactcaataatattccagaaaataagtttctttaaaaattcattacttgggcttaggaactcggaattcgattccgagcaaattcccaagtcccttatttttctacggaccctccaagaccatcaaatcacgggtccgggtccgtttatccaaaattttgaccgaagtcaaattagttcattttaaagtcaaaattaattatttttcacagattttcacataatggcttttcagctacatgcttggactacgcacacaaatcgaggtgatgctaaaagaggtttttaatgcctcggtaaatggaattcatttctaaaacaagtgatgacccaggtcatcacattctccacctctaaaacaatcgttcgtcctagaacggacataagaaggaagtacctaagacggggaaaagatggggatagcggcttcgcatattggactcggactcctaggtcgatgcctaagtaggctgacctctccactagacacgaacagaaggaaaactcttcgatctcaactgacgaacctgccggtctagaatatctaccggctccttctcataagacaagtccttgtccaactggacagtgctgaaatctaacacgtgggatgggtcgctgtgatatttccgaagcatggacacatgaaacactagatgcacggctgataagctcagcaacaatgcaagtatgtaagtcacctctcccactcgatcaagaatctcaaatgggccaatgaacctagcgctaagcttgcccttattcccaaatctcatcacgcccttcataggcgacactcgaagcaatacctgttcatcgaccatgaatgccaaatctcaaacattgcggtcggcataactcttttgcctggactgagctgtacaaagcctatcctaaataatccagaccttgtccaaggcatcctgtactagatccgtacccaacaaccgaacctcccccagctcgaaccattgaactgatgaccgacaccacctaccatagaaaacctcgtaaggagccatctggatactcaactagtagctgttgttgtaggcaaactctgctaaaggcaaaaactaatcccacgagcctccaaagtcaatgacacaagctcggagcatatcatccaaaatctgaatagtccgctcggactgcccgtccgtctgatgatgaaacactgtgctcaacgcaacccatgtgccccaactctcattgaactgccctccagaaatatgaggtaaactgcgtacatcggttcgaaatgatagacacgggcacaccatgaagacgaataatctcccggatatggatctcagctaacctctcggatgaataggagactgccataggaatgaaatgtgctgacttgaacagcctatcaacaataacccatactgcatcgaacttcctccaagtctgtaagagtccaacaatgaaatccagagtgatctgctcccacttccactcgggaagctcaatcctctaaaacaaaccaccgggtctctgatgctcgtacttaacctgctgacaattcaaacatcgagccacatatgcaacgatatccttctttattctcctctaccaaaaacgctgccgcaaatcttgacacatcttagcggcaccgggatgaatagagtaccaggaactatgggcctcctataaaatcaactctcggagtccatctacattaggcacacaaactcgaccctgcagtctcaaaactccatcatcacctaaggtaacctgcttggcacctccgtgctgcatcgtgtctctaaggacacacaaatgaggatcatcatactgccgatctcggatacgctccaatagaagaacgagcgactgtgcaagctaacactcggttgggcttagaaacatccaacctcacgaagtgattggccaaagcctgaacatccaaagcaagcggtctctcaccgaacggaatataagcaagactgcccatactggctgacttgctactcaatgtattagccaccacattggcctttcccggatgatataagatggtgatatcatagtcctttaatagctccaaccaccttgtctgcctcaaatttagctccttctgcttgaacaaatactgcagactcttgtgatccatgaaaacctcacatgccacgccatacagataaaacctccaaatcttcaacgcgtgaacaatggctgacgggtccgggtttgtttacccaaaattttgaccgaagtcaaattaattcattttaaagtcaaaattcatcattcttcatagattttcacataatggtttttcggctacatgcccggactgcgcatgcaaattgaggtgatgctgaaagaggtttttaaggtcatcacattctccacctctaaaacaaccgttcgtcctcgaacggacataagaaggaagtacatgagtcgaggaaaagatggggataacggctccgcatatcgaactcggactcccaggtcgatgcctcatcaggctaacctctccactgaacacgaacagaaggaaaactcttcgatctcaactaacgaacttggcggtctagtatagctaccggctcctccttataagacaagttcttgtcaaactagatagtgctgaaatctaacatgtgggatgggtcgccgtgatatttccgaagcatggacacatgaaacactggatgctcggatgataagcttggtagcaatgcaagtctgtaagccccctctcccactcgataaagaatctcaaacgggccaatgaacctagcgctaagcttgcccttcttcccaaatctcatcacgcccttcataggcgacactcaaagcaatactcgctcaccgaccatgaatgccaaatcttgatccttgcggtcggcataactcttttgcttggactgagctatatgaagcctatccagaataattcatcccttgtccaaggcatcctatactagatccgtacccaacaaccgagccttccccgactcgaaccatccaaccgacgaccgacaccgcctaccatacaaagcctcgtaaggagccatatggatattcgactggtagcaattgttgtaggcaaactctgctaaaggcaaaaaaagatcccacgagcctccaaagtcaatgacacaagcttagagcaaatcctccaaaatctgaatagtccgctcagactgcccgtccgtctgaggatgaaatgttgtgctcaactcaacttgtgtgcccaactctcgttgaactgccctctagaaacatgaggtaaactgtgtacgtcgatccgaaatgatagacacgggcacaccatgaagacgaacaatctcttggatatggatctcagctaacctctcggatgaataggagactgccataggaatgaaatgtactgacttggtcagcctatcaataataacccacactgcgtcaaacttcctccgagtctgtaggagtccaacaacaaaatccagagtgatccgctcccacttccactcgggaagctcaatcctctaaaacaaaccaccaggtctctgatgctcgtacttaaccttctgacaattcaaacaccgagccacatatgcaacgatatccttcttcattctcctccaccaaaaatgctgccgcaaatcctgatacatcttagcggcgcctagatgaatagagtactgggaactatgggcctcctctaaaatcaactctcagagtccatccacattaggcacacaaactcgaccctgcaatctcaaaactccatcatcacctaaggtaacctgcttggcacctccgtgttgcatcgtgtctctaaggatacataaataaggattatcatactgccgatctaggatacgctccaataacgaagaacgagcgactgtgcaagctaacacacggctgggcttagaaacatcaaacctcaagaactgattggccaaatcctgaacatccaaagcaagcggtctctcactgaccggaatataagcaagactgcccatactggctgatttcctagtcaaagcatcgaccaccacattggcctttcccagatgatataagatggtgatattatagtcctttaatagctctaaccaccttctctacctcaaatttagctcattctgcttgaacaaatactacagactcttgtgatccgtgaacgcctcacatgccacgccatacaaataatgactccaaatcttcaacgcgtgaacaatgctgccaactccaaatcatgaaccagataattcttctcatgaatcttcaatgctcgtgaagcatatgcaatgacatttccatcctgcatcaacaccacactaagtccaacaggatgtgcatcacaataaactgtataagccatgaacttgtgggcaaaaccaacaccagtgccatagtcaaatatgtgttgagcttctgaaagctcatctcacactcgtttgaccacctaaattaggcacccttctaggacaacctggtcatcggggctacgctatctctacaaacagacgatagtagcctgccaatcataagaaactccggatctctatagcttatgctggtctagaccagttcttaactgccttaatcttcttcggatcaacctgaataccctctattgatacaacatgaccgaggaatgcaactgaactcaaccagaactcacatttcaaaaacttggcatacaactgactatccctcaaagtctgaagaatcactctaagatggtgcttgtgcttctctcggctgcgggagtagatcaaaatattatcaatgaatactatcacgaacgaatccaagtaaggcctgaacactcggttcatcaaatccttaaaatttgctggggcattttcaacccaaatgacatcaccaagaactcaaaatgcctgtaccgagtgcagaaagctgtcttagggacatcggatgctctaatcctcaactgatggtagctagatatcaagtcaatattcaaaaataccttgacaccctgaagctgaccaaacaaatcatcaatcctcggcaacagatacttattcttgattgtaaccttgttcaactaccgataatcaatacaaattctcatcgatccgtcctacttcttaacaaacaacatcggtgcaccccaaggcgaaatactaggtctaatgaaacctttttcaagcaagtcttgcaaattctccttcaactctttcaactcaggcggggccatacgatatagcgggatagaaatgggttgagttccctaagccaaatcaatgcaaaagtcaatatccctgtcgggtggcataccgagcaggtctgaaggaaataccccagaatctcacgaacaacaggcatgaaattaatagaaggaacctcagcactagaatcacgaacataggccaaataggccaaacacctcttctcgaccatacgtcgagccttcatatatgagataacactacgggtagaatgactaggagtccctctctactctaaacgaggtaaacccggcaaggctaaggtcatagtcttggcatgacagtccaagatagcgtgtaaggtgataacaagtccatccccaatatgacatcaaaataaaccatgtccagcagaagcaaatctacacgagtctcaagactcctaatcataactatacatgaataacggactcgatctaccacaatacaatcacccacaggtgtagacacataaatagaagcactcaaagaatcactagacatgaccagatatggtgtaaaataagatgacacatagaagtacgtagatcctggatcaaataaaatcaaagcatctctacaacaaaccaaaaaagtacctatgattactgaatcggaagcctcagcctcgggcttggctggaagagcataacatcggggttggtccccaccaccctgaactacatctctaggacagcctgctgcaggctggcctccacctctagcggcctgagctccacctctaatacctctacctccacctctagcacctctacccccacctctagctggttggggggctttagaacactcggtgcctgaaccatggcacgggaacactactgctgagaattacttggtgctcgagggcaatatctagcaatatgcttcgtgtcgcaataagtaaaacaagcccttggttgctagggctgacgaccttggaaactctgaagcggcggtgtactgataagagctggtggtgcactgttggtctgctgatcagaatactacatatgagaaccacggccacctgaagcaccatgagaatcctgaagtgctgactgaaaaggccttggaggatggcatctaccatacgaatctctacctccagacgaggtaccattgaatcggcctgaatgacgaggccttttgtcagacccctgaccacctccctgcgataaaaccatctcaactctcctggccacattgaccgcctcctggaaaaaaatctcactcccagtctccttggccatctgaagtcgaatcagctaaataagtcccttaatgaacctcctcaccccttctctctcggtgggaagtattataagagcatgacgagccaagtcgatgaatctggtctcatactgagtaacggtcatagatccatgctggagacgctcaaaccgcctctgataggcctctctttgagtgatagggagaaacttctacagaaataactgagtaaactactcccaagtcaaagctggtgatctggctggtctagccaagcaataatctctccaccaagtcttggagaatccagacaagcgaaaagtagcaaaattgaccccattggtctccactatccccatgttcctgagaacctcatgacaactatctagataatcctggggatcctcagaagatgcaccgctgaaagtagtagtgaagagcttggtgaacctgtccaacctccacaaagaatcggcagacatagctgctccatcacttgtctgagctaccgcacccaactgaactgctccaactagctgaactgctggagtctggaactggggagctaccagctccggagtgcaagtagcaggagtctaagctcctcctccagcctgagagatggttggggctataggaagcaatgctgcccgggtgacactctccataaggcccactagatggaccagagcatcctgcagtatgggggtagcaataaactcctctgggacctgagctaggcccatcggaactgtcgaggccagaacctcatcatcaatgtcaacctaaggctccgccgctggtgctgctgctctgggttgagctctacccctacctcggcctctagcacggcctcggcctcgccctttgcccctcgtgggagatgatgctgggggctcgggctactggtcagtggatgaggaatcacatgttctcgccatctgcgaaagaacagagtcgaaattcaattagcattgagaaaccaatcagcacgaccggaaggaataaatgtgaagtttttcctaactttgtagcctttggaagataaatacagatgtcttcgtaccgatccctcagactttactaagcttgtatatgaactgtgatacccatgtaacctagagctctcataccaacctatcacgacccgaatttcccatcctcgagagccgtgatggcgtctactggtgaaagctaggcaagccaagttattctaaatacttaaccttttcagtttttaaaccattatcagtgatgagtagatatcatgcaattagcgaaaattattaagctgaacacaaaagctgataattaatcttaatacaaactgcggaagtctaaatacagctctacccagaatttggtttcacagcctcacagacggtctaagaatactacatacaaagtctgaaagataaaatatacattgtttctgaaatgagtaaaggaaacaggataaaggaacgataggaggtgacgccaaggcccgcagacacctgcaggactacctcaggtcacttgttggactgaaggtagcaaccccactgcggtctgaagtctacaacattgggatctgtacaaaagagttcaaagtatagtatcagcaaaaccgaccccatgtgctagtaagtgtcttgcctaacctcggcgaagtagtgatgaggctaggaccagactactaaataaacctgtgcagttatatcataaacagccgaaatagaagcagataattagaattaacattgggcaggggaaacatgcttcggggaataacaaataacaatagaatatcaagagaatataaagaaaccaaaatcgaattactaacacggatagggaaaacagatgcagagttcactttcatttcacatctcgttgcaggcgtgcatcccgatcccgtttcatgtatctcattgtaggcgtgcaaccctatcccatttcatatatcttgttgcaggcgtgcaacccgatcccatttcacatatctcgttgtaggagtgcaaccagcttccatttcatatatcttgttgcaggcgtgcaacctgctcccatttcatatatcttgttgcaggcgtgcaacccgctcccatttcatatatttccgtggcagcgtgccacccgatcccatttacaaatcaacaacaatcacaaaagaatcccggaaagggaacaattatatttcagcaatatccggcaagggaacaataatgataataacatgtgaagtgcaataaatcacaacggagtcataacaattacaatacaagactcacgggcatgcttgacaccgacgtatagatactcatcaccatgcctatatgctgtaatccacaattaacacgtagcaaataagacacgactcctaatccctcaagctaaggttagacaaaacacttaccccgataccatgaacacaattcaaacctcaactatcactttacctcgtgattccaccgccaattcgcacgtatctagccacaagttacttaattacatcaataaatgctaaatgaatcaatcctaatgcatgaaaatgagttttctaaagttttacccaaaaagtcaaaaattgccctcaggcccacatggttaaaacccgaggtttgaaccaaaacccgattacacattcccccacgaacataaatatataatttgttttcaaattggacctcaaatcgaggtccaaatcctcaatttttgaaaaatctaggttctacccaaaatacccaatttctcccatgaaaatcattgattttgagttgaaatcaagtgaaaagatgttaaagatagaagacaattagttataaatcacttacaaatgatttggaagagaagttgcctttgaaaaattgccctacagagtttatgttttgagaagatgtgaaaaatggttgaaaatgcgtctaagttatgaacttacaggttgcaggtattacaattgcaatcagggttcgcaattgcgatcaaaggctctgctaagctcgcatttgcgaagtcgcttttgcgataaatttgtcgcatttgcgatgactggggagttcagggtatcttcgcatttgcggaatcgcttttgcgataaagtcgccgcatttgcgacccaaggcagcccaggccacttctcgcatttgcgactcattgctcgcatttgtgagccagacttcgcaattgcgaagcctacaagcctgaagcataccagataaaatttgcaacatccgaagtccaaattccaatccgtggcctatccaaaactcactcgagccctcggggatccaaaccaaacatgcacaacaacctaaaaatagaatacggactcgctcgtgcattcaaatcaccaaaataaatcaaaaactatgaatttagcatcaaatcatgaattttcttaagaacttcaaattttctcaaatacgatccaattcatgtcatcacaagtccgtttattaccaaatttcacatatttatcttaaatcacatataagacctataccggacaccgaaaccaaaatacgagcctaataccatcaagttcaaaacacgtatcatttccaaaaaactctataatattttagaaaataattttctttaaaaattcatttctcgggcttgggatctcaaaattcgattctgggcagacgcccaagtcccatatttttctacggaccctccgggaccgtcaaatcacgggtccaggtccgtttaccctaaatgttgatcgaagtcaaattaattcattttaaagtcaaaatttatcattttcacagattttcacataatggcttttcggttgcacgcccggactacgcacgcaaatcgaggtgatactgaaagaggtttttaaggcatcggaacacagaattcatttctaaaacaagtgatgacctcccacattctccacctctaaaataacagtttgtcctcgaacggacataagaaagaagtacctgagtcagggaaaagatggggataacgactctacatatcggactcggactcttaggtcgatgcctcagcaggctgacctctccactgaatacgaacagaaggaaaacttttcgatctcaactgacaaacctgccggtctagaatagctatcggctcctcctcataagacaagtccttgtccaattgatgcagtgtgggaaggtgattggttatgcatcaagacaattgaagaagcatgaaaagaattatccaacccatgatttggaattggctacagtaatatatgctttgaagatatggcggcactaattacacggcatccatgttgacatctacacatatcacaagagtttacaatacatcttcaagcagaaagagttgaatttgaggcagcgtaggtatcttgaattattgaaaaactacgacgtcgagatattgtatcatctcggtaaagccaatgttgtggcagacactctcagccataaatcaatgggaagcttagtacatattgaggcaggtagatgggggttgactaaagagcttcatcatctagccaatatgagaatcagattgttagactctgatgacggaggtgttactgtacagaatacatcagaatcatctttggtagccgaggtaaaagcacgacaatatgaagatcctatcttagtacgattaagagagagcattcagcagtgtaaaagtatggcttttgagatcggaagagatgggacactgagataccagggccgattatatgtgcctaatatggcagagttgcgagagaagattatgaatgagattcatcaatcccgatattccatccatcccggctcgacaaagatgtatcatgatgtcaaggagcagtattggtgggataacatgaagaagtctattgcagaatttgaagcccagtgtcccaattgtcaacaagtaaagatagaacatcagaaacccggtggattgcttcagaatatagagattccgacctggaaatgggaggtgattaatatagacttcattattggattacctcgctcttatcataagtttgaccctatctgggtgataattgatcgacttacaaaatatgcccattttctgccagttaagacaacttacaaggctgaagattatgcgaagttgtatatcaaggagattgttaggctttatggtgtgccggtatctattatatcagaccgaggagcttaatttacagctaacttttggaggtctttttagaagggtttaggaacacaattgaatctcagcactgcatttcatccgcagactgacggacaggctgaacgtaccattcagacactggaagatatgctacgagcatgtgttctagattttaagggaaattgggatgaccatcttccactcatagaattcgcctacaataatagctaccattctagtattaaaatggccccatacgaggcactatacgggagaagatgtagatcaccggttggatggttcgaagtcggtgaaacagaattatatgggccagatttgattcaccaagcttttgagaaggtgaaagtgatacaggagcgattgaggacggcacaaagcaggcaaaaatcttattccgatgtccgacgtcgtgatctgaagtttgaggttggtgattgggttttcctgaggatctcaccaatgaagggtattatgcgttttgggaagaaaggtaagctgagtccaaggtatatcgggccatataaaattcttcgacggatgggaaaggttgcttatgagttagaattgccatccgaattggaatttgtccacccggtattccatgtatctatgttgaggaaatgtattggagacccttcttgagtcgtccctatcaaagatgtacaagttacagaggacctatcatatgaagaagttccagtggcaatattagatcgacaagtccgcaagctgagaacaaaaaatgtagcttccatcaaagtattgtggaggaacaaaaatatggaagaaatgacatgggaagtagaagaggagataaagtctaaatacccttacctattccagaatgaagataacaaggatgctggtggaagacaggatacattggaatgtgaaacggctctatgaggtaagcaataatttgagaatactcctccttaatgcaaaatggtgatatgtagataatgtaaatatgaataatgctttgtgtagccttgtgaagccatatgttgggcttaattgcttgcaagtattgctagtgaccattttataggggaaaattgatcggaaatttccattggaatccacgatgatttaaactccccatgaacccttacattcgaggacgaatgttcctaagggggggagggtgttacaacccatatccacatgtgttagttcatgtcatatattagttaacataaatccaagaaggaattatctttgagatgataagaagtcaatcatattgctcttaagtgatacaagagtgtataagggtgattaacaagtattagaagttaaatgaatcaagaatgttgtaactcgtattttcaggtaaatctagcggtgcttaatacactcaagaggtcatgtattaaagtattttaatcatataatatctgtatcataagtattgaagtcaaacgagttatgaaacaaaagtcgacaaaagttgtctcaacttaggttcataattttacttaaacattaggtcaaatgtttctaatattttctcctaatttacaaggaattatggggttatctaccaaccaaattaaatatctatgagtctagtttccaacgcaataaaccgttcatcgatacgatctcggagtagagagatattcgcatttttgcaagactgcgccaagcacctctctatggggcccactaaggcggtttaagatatttggacctatataggattcctccaacccattttaagtcatttcttctcactattttcagaccttagaaccctaggaacatcctctcaaggttctctcaagattcaagacccaaaaaaggggcaaacaacacaaatcaagtgtcgggaattccgtggcgctagtaagtctcttgttcttcttgttattgctcatttttgtgtcgttctagctcgtgtgggaggttattttaaagggtttatgttttgtatatactccctcatgttattaatatcaatcctaggtgatttcaagccttctaaagtaattctagtgccgaaaaacactaattgatcgctagtttcgcttttttgttgttgtggcagcattggagggatatttcatggaaatgtaaggtcaattggagttgttatttctgtataaaggtaaggaacctcttactctatatgtatttaagattatccaagttgcagctaagccattgaagctagaacttgtgaaatatatatcaaaaggcttggtagtaatgttattgttttgtggactgttttgcgttgctgttgggctgcgtattttactactattttgtggagttttggaggaggaagggtgtggagaaacacaatatatatgtagggttgtgggatgatatttatttgtaacatttttgggtcgtttgacacgactacggtggtcgtcgtatgtatggagtgattaggctgtgcgtggacaattttgggaggctcaatatgtttattattgatgttgtttgggctgtttggtgactgttttgaatggtgtgaagtcatatatataggggaggtgttgtccatttcatcgtaaaattggttgtggtcgatacataatagttatgacgcttaaatgataacgatagtatcgtttctcttattgtagactaaggagttttgacaattgcatagcttgagattggggaagtatatacaaggtatgtgaggctatacctttccttcttttgcacgactccgattgtacataatgtaatgaacgagcttccaagatactctactcttagaagctagcaatacttacattgttttccctcttatggaacgattgatgttaatgttgcttctcttattcttatcttatcaatgttgttggtacttcctgattcttatacggttcatagtgaagagttagtcctaataacgtgtacagaggataccgaccttacgtcactcctaaaggtttagaatgtgattccatgagtcgagcatgcattatatatatgtatctattttaatttaccgagccacgctatagttggccgggtatggcacctattgtgaaactactgatcagttgggttttaccgagcctattatgaccgggtacgatatgatgatgatgatgcccacggaggcgaatgttttaaaggtttatgtatttatacatatgtatcatgcatttcatgttagtagccctcagaggtactaagatgttacaggttgtatattctctatccttgcttacactactgatcgtatttatggttccctgccttacatactcagtactttattcgtactgacgtccttttatttgtgaacgctgcatgttgtgctgcaggtcctgatagacaggcaggtgcagctcccccaccacagtaggctgtccagttcagcggtgattggcgagatcccttctccggacttgccttggtcttggtatgcatttttgttatagacattatgggtatgtcggggccctgttccggctatgttgcagcacttatgttcatttagaggctcatagacaagtgtcgactcatgtatagtttggtatgccttgtcggctggtttttgttatatagtcattcatggtagcgtggtagctcataccttatatgtagtttcttgattgtctggtcatcccctgctatgtatgttcatgccgtcatattttatttctggttgtccatgatccaggtctaccatttatattgatctcgtcagccctaaaagataataatgaaggttagatgaaatgtacgttggtgctcggcaagtatggtcgggtgctagtcatggccctccagtttgggtcgtgacaccaaatctcgaaccttgcggtcggcataactcttttgcctggactgagttgtacgaagcctatcctgaataatcctgaccttgtccaaggcatcttatactagatccgtacccaagaaccgagcctcccccggctcaaaccatccaaccggcgaccgacatcgcctgccatacaaagcctcttaaggagccatctggatactcgactggtagctgttgttgtaggcaaactctactaaaggcaaaaactgatcccacaagcctccaaagtcaatgacacaagctcagagcatatcctccaaaatctgaataggccgctcggactgcccatctgtctgaggatgaaatattgtgctcaactcaacctgtgtgcccaactctcgctgaactgcctccagaaacgtgaggtaaactacgtacgtcggtccgaaatgatagacacgggcacaccatgaagatgaacaatctcccagatatggatcttagctaacctctcgggtgaatagaagactgccacaggaatgaaatgtgctgacttggtcagcctatcaacaataacccacactgcgtcaaacttcctccgagtctgtgggagtccaacaacgaaatccatagtgatccgctcccacttacactcgggaagctcaattctctgaaacaaaccaccaggtatttgatgctcgtacttaacctgctgaaaattcaaacacaaagccacatatgcaatgatatccttcttcattctcctccaccaataatgttgcagcaaatcctgatacatcttagcggtgtctggatgaatagagtacagagaactatgggcctcctctaaaatcaactctcggagtccatccatattaggcacacaaactcgaccctgcaatctcaaaactccatcatcacctaaggtaacctgcttggcatctctgagctgcaccgtgtctctaaggacacacgaatgagaatcatcatactaccgatctcgaatatgctccaataaagaagaacaagcttctatgcaagctaacacacggttgcgcttagaaaaatccaacctcacaaactgattggccaaagcctgaacatccaaagcaagcgatctctcaccgatcggaatataagcaaaactgcccatactggctgacttcccactcaaagtatcagccaccacattggcctttttcggatgatataagatggtgatatcatagtcctttaatagctccaaccaccttgtctgcctcaaatttagctcctactgcttgaacaaatactgcagactcttgtgatccgtgaacacctcacatgccatgccaaatagataatgcctccaaatcttcaacgcgtgaacaatggctgccaactccaaatcatgaaccagataattcttctcatgaatcttcaactgtcgtgaagcatatgcaatgaccttgatatcctgcatcaacaccgcaccaagtccaatacgagatgcatcacaataaactatataatgccctgaacctgtgggcaaaaccaacaccgatgtcatagtcaaagctgtcttgaggttctgaaagctcgcctcacactcgtctgaccacctgaactgggcacccttctgggtcaacctggtcatcggggctgcgatagatgaaaacccctccacaaaccaacgatagtaaccttccaatcccaagaaacttcggatctatgtacttgatattggtctaggctagttcttaactgcctcaatcttcttcgtatcaacctgaataccatctgctgatacaatatgacccaagaatgcaactgaactcaaccagaactcacatttcgaaaacttggcatacaactgactatgcctcaaagtctgaagaaccactctaagatacttcttgtgctcctcccggctataggaatagatcaaaatatcatcaatgaagactatcatgaacgaatccaaataaggcctgaacactcggttcataaaatccataaaagttgctagggcatttgtcaacccaaatcacatcaccaagaattcataattcccgtaccgagtgtagaaagctatcttagggacattggatgctctaatcctcaactgatggtagccagatctcaagtcaatcttcgaaaataccttggcaccctgaagctgatcaaacaaatcatcaatcctctgcaacagatacttatacttgattgcaaccttattcaactaccgataatcaatacacattctcatcgatctgtccttcttcttaacaaactacaccggcgcaccctaaggcgaaacactaggtctaatgaaacctttttcatgcaagtcttacaactgctccttcaaatctttcaactcaggcggggccatacgatacggaggaatagaaatgggttgagtgcccggagccaaatcaatacaaaagtcaatatccctgtcgggtggcatacccggcaggtttgaatacccgacaggtctgaaggaaatacctcgggaaactcacgaacaacaggcacaaaatcaatagaaggaacttcagcactagaatcacaaacataggccaaataggctaaacacctcttctcgatcatacaccgagccttcatatatgagataacactatgggtagaatgactaggagtccttctccacactaaatgaggtaaacccggtaaggctaaggtcacagtcttggcatgatagtccaagatagcgtggtaaggtgataaccagtccattcccaatatgacatcaaaatcaaccgtccaacacaatcaaatctacacgagtattaagactcctaatcacaactatacatgaacaatagactcaatctaccgcaataaaatcatccactggtgtagacctagaaacaggagcactcaaaaaatcactagacatgaccagatacggtgcaaaataagatgacacatagaagtacgtagatcctggatcaaataaaacgaagcatctctactacaaactagaatagtacctttgataactgcatcggaagcctcagcctcgggcctggctggaagatcataacatcgggactgggcccaccaccctgaactatatctctaggacggcctgttgctggctggtctccacctctagcggcccgagctccacctctaatacctctacctcaacctctagcacctctacccccacctctagttggctgggggctgtggaacattcggtgcctgaaccatggcacgggaaccctgctgctgagaactgctcggtgctcgagggcaatatctagcaataagcctcgtgttgccacaagtaaaacaagccctcggctgctggggatgatgaccctagaaactctaaagcggcggtgcactaatagaagctggtggtgcactataagtctgctgaccggaatactacaatgagaaccatggccacctgaagcgccgtgagaaacgtgaagtgctgactgaaaaggcctaggaggatggtctctaccatacaaatctctgcctccagacgaggtaccactgaatcggcctgaatgatgaggcctcttctcagaccactgaccacctccctacgataaaactatctcaactctcccagccaaattggtcgcctcctagaaagaaatcttactcctagtctccttggccatctgaagttgaattggctgaataagtcccttaatgaacctcattaccctctctctcggtgggaagtatgataagagcatgacgagccaagtcaatgaatctggtcccatactgagtaacagtcatagatccctgctggagatgctcaaattgcctctaataggcctctctctgagtgacagggagaaacttctcaagaaatagctaagtaaactgctcccaagtcaaaactagtgatacatctggtctagctaagcaataatctctcaccaagtcttggcggatccagacaagcgaaaagtagcaaaatcgaccccattggtctccactatccccatgttcctgagaacctcatggcagctgtctagataattctggggatcctcagaagatgcactgctgaaaatagtagtaaagagcttggtgaacctatccaacctccacaaagaatcgggagacatagatactccatcacctgtctgagctaccacactcggctgaactgctccaactagctgaactactggagtctggaactggggagctacctgctccggagtgcgagtaacaggagtctgagcgcctcctccaacctgagagatggcttgggctacaggaagcaaacctacccgggggacactctccataaggcacactagacagaccagagcatcctagagtatgagtgtagcaataaaccactctaggacctgagctgggcctaccagaactgtcggggcggaacctcatcatcaaagtcaacctaatgctccgctgctggtgctgctgctctgggctgagatctgcccctacctcggcctctagcacggtctcggcctcgctctctacccctcgtgggagctgctcttgggggcttgggctgctggtcagcggatgaggaagctcgtgttctcgccatctgcaaaagaatagagtagaacatcaattagcattgagaaaccaaaccgcacgacatgaaagaataaatgtgaagtttttccttaactctgtagcctttaggggataaatacaaacatcttcgtaccgatccctcagactctactaagattgtctatgaactgtgagacccatgtaacctagagctccgataccatcttgtcacgactcaaattttccacactcgagagtcgtgatggcgcctactagtgaaagctaggcaagccaagttattctaattacttaaccttttccagttttaaaccattattagtagtgagtagatatcatgcaattagcgaaaataatcaagtggaagacaaaagctgataattactcttaatacaaactgcggaagtgtaaatacagatctacccagaatttggtgtcatagcttaacagatggtctaagaatactacatacaaagtctgaaagataaaatatacattgtttctgaaatgactaaaggaaacaggataaagaaaagataggaggtgacgccaaggcccgcgggcacctgcaggactacctcaggtcacttgttggactgaaggcagcaacctcactgcgatccaaagtctagaacactgggatctacacaaaagagtgcagagtatagtatcagcacaaccgaccccatatgttggtaaatgtctagcctaacctcagaaagtagtgacgaggctaggaccagactactaaataaacttatgcagttatatcataaacatcgaaaatagaagcagataattataattaacattgggcaggggaaacatacttcggggaataacagataacaacaaaatatcaagagaatataaagaaaccaaaatccaattacaaacatggatagggaaaacaaatgcagagctcactttcatttcacatcttattgcaggcgtgcaacccgatcccatttcatgtatctcgttgcaggcgtgtaacctgatcccatttcatgtgtctcgttgcaggcgtggaacccgatctcatttcacatatctcgttgcaggcgtgcaacccgctcccatttcacatatctcgttgcaggcattcaacccgctcccatttcatatatcttgttgtaggcatgcaacccactcccatttcatatatttccttggcagcatgccacccgatcccatttacaaatcaacaacaatcacaaaagaatcccgacaagggaacaattatatttaaacaacatcccagtaagggaacaataatatcatgacaacatcccggcaagggaacaataatgataataatatcccagcaagggaacaataatggtaataacatcccggcaagggaacagtaatgataataacatttgaagcgtaataaaccacaacaaagtcataacatttacaatacaagactcacgggcatgcttgacaccgacgtatagatacttgtcaccatgcctatacgtcgtactccacaattaacacgtagcaaataagacacgactcctaatccctaaagctaaggttagaccaaacacttacctcgatgccacgaacacaattcaagcctctactatagctttaccttgtgattccaccaccaattcgcatgtatctagccacaagttacttaattacatcaataaatgctaaatgaatcaatcctaatgcatgaaaataagttttctaagttttacccaaaaatctaaaattgcccccgggcccacatggtcaaaacccgaggttcaaaccaaagccagattacccaaatcccccacgaacccaaatatataatatgtttagaaatcggacctcaaatcgaggtccaaattgccaatttttgaaaaacctaggttctacccaaaacacccaatttcccccatgaaaatcattgattttgagttgaaatcaagtgaaaagatgttaaagattgaaaaaattagttagaaatcacttacaatagatttggaagaggagttgcctttgaaaaattgccttagagagtttatgttttgagaagatgtgaaaatggttaaaaatgtgtctaagttatgaacttacaggttgcaggtatcgcaattgcgattagggttcgcaattgcgaacccaggctctgctaatctcgcatttgtgaagggactttcacatttgcgaagtcgcttttgcgataaatttgtcgcatttgcgatgactgggagttcagggcatcttcgcatttgcgaagggactttcacatttgcagaatcgcttttgtgataaagtcgtcgcatttgtgacccaaggcagccaggccaattctcgcatttgcaactcattgctcgcatttgcgagccaggcttcacaattgcgaagcctgcaggcctgaagcataccagataaaatctgcaacatcctaagtccaaattccaatccgtggcctatccaaaactcacccgagccctcggggctccaagccaaacatgcacaccaacctaaaaacatcatatggactcactcgtgcattcaaatcatcaaaataacatcatcaactatgaatttagcatcaaaatcatgaaatttcttaagaacttcaatttttccaattttctcaaatacgatccgattcatgtcatctcaagtctgtttattaccaaatttcacagacttatcttaaatcacatataagacctgtactgggcgccaaaaccaaaatacaggcccgataccatcaagttctaaacacgtatcatttccaaaaactcaataatattccagaaaacaattttctgtaaaaagtcatttctcgggccttgaatctcggaatttgattccgggcatacgcctaagtcccatattttattatggaccctccaggaccttcaaatcatgggtatgggtccgtttacccataatattgaccgaagtcaaattaatttattttaaagtcaaaatttatcatttttcacataatggctttccggctacgcgcccggactgcgcacgcaaattgaggtgatgttgaaagatgttttaaaggcatcggaatgcagaattcatttctaaaacaagtgatgaccttttgggtcatcatagtgcgagaccgtagaaacagtcgccctctcgcagatgcggccaaggaaggccaggccagaaaccgcaaaagcggctccgcaaaagcggcttcaagatcgcagaaccggtcccagcccacttggcccttctacaaatgtggcctcttcctctcagaagcgggaccgcagaagtagaaattgctgaagcagtgagcttcatttaatacaagtcctaagtcatttttgccccttttcactcctcctttgggcgattttggagctttggagagaaaacttccacctggcgccttgaggtaagtttaacccacctattcctagtttaatacttatgtattaggtagattaaacactaagattaaggtaaaatcatggggttagggcaaaacctagggttttgacaaaagttggatttgaccacgaaattttgctatgaaatgaattagaaatcatatattattgatccttagattatagagaataactttttcgaaaaatttcgaaatccgggcacgtgggctcggggtcgaattttaggaaactagtgttaagggttggtaaattgcttaaatagctagaatacgatcttgtgagcttatattgactagttcctacctcatttaactagctttggatcattcgtctccaaattgagagtttgggatcgttcttggcatttgaagtatactttggagcgaggtaagtatcctttataatcttgtaagagggaattgtccccataggtgtaataattgaataaattgctactatatgtgcgggctacgtacgcactaggtgacgagagtccatgcgtagctactattatgctaagtccgggtagtctaggacccaaaaacatgctctatgtgatattcttgtaacttcatgtttaattcgaatttgtataaatcatgttgattggggtaaatgagactagtaagaggaacattatctttcttggcctttaaagagaaattgattatttctatgtgtaattgtttcccagatatacactattgtctgtttgttgttgtgttatttatatttgaccgcgtcgcatgtttgattcgcgagcggggtaatagatgcatatatggttcgtgttgttcgaccctcggtagtgcacaatttaattttatgttggatcgagccgtacaaccctcggcattacttgcgcaagttttacttagtatttttctgtggactgaacttcgtttatgccttggaatgcagatggttaactatgatattatcaggaaaatggaaccattatttcttgcgatgaaatgctaattaattgtactatccatgcttagtataaattctttctcatattatttgaccctagtaagtataaagtcgacctctcgtctctacttcttcgagattagacgggatacttaccgggtacatattgtttatatactcatactacacttctgtacttaattatgcaagatctgaggtagttacctctggctatcagtctggtgcgtattcctaagcagatttcgagacttctacaatgagttactttccttccagtgccgttcagcagctagatggagtctctcttatttatttttgatgtctattctattttggacagtaggatagattgattcttttgtatattctactagtttcccacaacttgtgacaccaggtcttggcacccacaatagtagattattcttttggggattgtataattatttttggtacattactggttattactcgttcaaatcttaacttaagaaattattgcaagtatgttggtaaaagtaaaatgagagcttatttggtatttttccgcgttggcttgcccgacaatggtgttgggtgccatcatgacctattatggaaatgggtcgtgacacgaattgcttaaaagtcaaaaataagccaaaagacataagctggtcacctccagcttatgaatttttagcttataagaactttaagtttgaccaagatttttactattttatccttaaaatattcctttttagaacaaaattcctatcttgatactcactgcctcaagtattttatcaacttaaccccctccccccgcgcctctttaagtctgcaattctcattgactatttaagataagcaaattctctatttctttgcaaatttgtatctatgtgattgtgtattaacctttgaactgtatgtaataaatgaggatatatcatatttttggtgtattgttttctaagtgttgtggtgatgaaaatttctcttcaaatattgtgtcctatttatgtagaaacttttgtcaatttattaatcattataacttatgattatatgattatcgtaaaaaaattatattatcataaaaattattttatctaagcacagttgtatttaaaataaaatggcaaatagcatattttgtagttgaatcaatttgaaatctaaaattttgtagaaattacgtctttataagtataaaaagttctaaggttatttaagttattttaacataaaaagtacttatcaacatttttttatcaaatactgcagcaacttattatcaatttcagcacttgttcccaaacacataactggtaatttattaaatcagttttagcacttaaaaatgtttttcagcacctaatgcctatcatctacttcaaatcaactaatccaaacgggctctaatttagttcaatttactaagctaaatagcatgggctagccagttttcggattgatcattcaaaaatagccagtatttgtaaagtgattgtaaaatagccactattttgctgcaacagggaccagtccagcataatatattggagatttgtgcacctgtatatgaacttccagcatattatgctagaactccaacacgcggaaagttccaacataatatactggagataggagcacctgtgtatgaacttccagcatattatactggactggtatattatactggaactccagtatattatgctggagttccaatatacttatgctgaaactccattataatatgttggagttccaatgtacttatgttggaattccattataatatgctggagttccagtatacttatgctggagtatttttcggagtttgaacagtattttcgttcaaatttatctttacataaaaagtgggtaattttcgattacttttaaagctatagctgtttttggatgatcacttataaatttgattatttttaaatttctccctcgtaaatgagccaaatgatcatcaattcaaaatatcagcaccatcaattcttttaactattctagtaaataaataaaaaatcgtaacaaagtaatacgacattctagataggaaaatacaccccttcaattcaaacaaatatagtgtacgtaatttaatcatattcacaatcaaattgccacttattgatgattgacacataactataagcaaaacaggccaaagcaacttcaataagaaaataaatacaccgcttccatcaattattacaaataaaataatattcctagttcatgtattaaggagtacgatttattttaattatgtagcaggcactataaacatattgggtagagctgtcaaaacggaccagcccagcccagcccagccaagcttcgtgggcttttaaatttggtgagctaggccggcctggcccgccatatgaatgggccttgaaatggtcagtccaacccagctctaagagggccgcgggctagggcgggccggcgctccgatttttttttagaaaaaagaatttctttaaatcctcaaatattttttaaacaacttctgtttgcttagagcgtacaaaaagcttgatatttgacgagaatctcgtaattgaaatacaaattctatatatctctaactcttcttttctaaagttacatgaatattttcttaatacttttctttcatttttctcagattcacggattgcttcaatacatttatatcctgagtttttttaatttatgatttacataatttgctgatttcatcattataatccataaaaactttaaaattcctaagatttgatagtggtcaatttttatttgtgtatttaaaattgatctttttatatactgaagagcagtttaaatattttctatacttaaagtatattttcttttgaaaaaagattattattggtcacctaaaacttttcgagttcgttattaattaagtaaaaaaataataattttttcatattacatacatgtcaaaaatctaaattccagttaatatggaagggtaaatgagtaatctaaggttggggaataggataatagttaatagttttttagtttttacttttttaaatattaaatatttaataatgtcacgaccctaaacccggaccagtcataattgcgcctctcgtgaagacaaggccagccagttaaacccaattccatttttaaacagttaaacaataagaaacagtctaagcatgaataaatatatcaaagtagtggatgatattataaatatgcggaagaacaacccaacacagccgatatcggggtgtcactagtcatgagcatctataagtcataatacaagtctgctaagtctataagctagtacaaatgtctgaaagaagatagaaatgataaaggaggagaaacacaggactgcggacgtcaagcagctgcctcgtggacttcgatatctgccgggagatctcaactcgcactagcaggatccgcaacgcctgaatctgcacacaggggtgcagggagtaaagtgactactccaactcagtgagtaaaaattgtaaataaagactgaaagcaagaaatcacgtaaggcacaaagtattttataataaagcagtaaaacaattaaaacagtaaactagtgaaagataggtaaaattctttaactcaaacgtagttttatgaaaagcctttttcaataattaagcatgtaattgacagtcaattgtgaaaagtaaacacataaaggcctgtccctcgggcacagtatcaacaaatcctcccttcgagcaacatctcagaacagtaccagcccctcgggctcaatctcatatcacaatgggtatccgcgctcactgggggtgtacagactcctggaggagccccttacggcccaagtacaatatcaagccacctcgtggcatcatcactaggcccttggcctcatatcaatcaggccacctcgtggtgtacatatctcatgtcctcagcctcataatcagtaccaaatgtttcctcacaacataggcccttggctttactcagtcaaaaaacctcacaagccacccaggtagtagtaaaacatgtttttcagcccaaaatatcatttaaaagatcatgtaagtgttaaaacagagtaaacatggctgagtacgaaaaacagtaaaatataacatgactgagttcaagtataaagtcaaaacagtgaggaaataccagtaaaaatccccgaagggttcaaatagttggcacgaagcccaaatatggtattcaacgcaaataatgatgatagcaaatagatttcagtaaaatacgcagtaaaaccatcgatcgggacggaccaaatcacaatccccaatagtgcacgaccccacgctcgtcatcaagtgtgtgcctcacctcaatatagcactatgatgtgcaatccggggttttaaaccctcataacatcatttacaatcattactcaccttgaacctgtcaaagctctagttcgcgacgcctttgcccctcgaatcggcctccactcgcgttgaatctatccaaaatcagaacgaggaagtcaaaatatgctaggggaacgaagcccaagcgaaaataatcaaaatacgacacaaatcccgaaattactaaaacccgacccccgagcccatgtctcggaattcagtaatttttacattaatagattcattatctccccacgagttcatacatatcaaaagttctgaaatccgacatcaaatggtccttcaaatcctcaatcaaaggtctacatttccaagccctagtttccccaattttcacccttaatttccatgatttctagctctaatccgtgaaataatagcataggaatgagttttaggtccaaattacttacctcaatgaagttcccttgaaatcaatctttcaaatcgtccaaagctccaaagccgagataaaaatggtgaaattagctcaaattcgggaaggccacaatttatactttctgcctagccatttttgcatctgcggctatatttccgcttctgcagtaccgcatttgtggttcttcctcctcttctgtggaaatcacttattccccttagtccgcatctgcagcatcgcagatgcagtcctcttagccgcttctgcggtcccctacctgcatctgcggcatcacagatgcagacctcttagccgcttctgcggttcctgcacctcaagccattttcgcttttgggaacaattcctccccttatgcggcgccgcacctgcggtcccctatccgcaggtgcgaaaataccagaagcagcaaattcagcagctgcaacaaagtccaaacttctccgtcaaccatccgaaatcaccccgaggacctcaggacctcaaccaaaagcatcaacatattccaaaaccttattcaaacttgtaccaatcttcaaaacacctcaaacaatatcaaatcaaccaaaacacatcggattcaagcctaattttccaaaatcttccgaattccgcttttgatcaaaaacccaatcaaaccacgtccgaataacctgaaatattgcacacacatcccaaatgacatgacgaaactactgcaactcttggaattccattccgacccctatatcaaaatctcgcctacccactgaaaaattgccaaaatatcaacttcgccaattcaagcctaaatctactccgaacctccaaaactcattccgatcacgctcctaagtcccaaatcacctcccgaagctatccgaaccatcagaactcacattagagccctctaacacataagtcaacatctgggacttttccaacttaagcttcctcaaaagagactaggtgtctcaaaccttaccaaaatcattctggattcgattcgaccaacccgataccacataacacggataaaaaaagcataaagaagaagaaatgggggaaacggagcggtaactcatgagacgactggccaggtcgtcatatcctccccaacttaaacaaacgtttgtcctcgaccgaatcaagaaatatacatgaagcctcaaacaggtgaggatacctactctgcatatcgcgctcggtctcccaggtagcctcctccacgggccgacctctccactgcactttcactaaagctaatcctttgacctcaactttctaacctgacgacccaaaatagctactggctccacttcataagtcaaatcatcatccaactgaactgtgctgaaatccaaaacatgagactgattcccaatatacttccggagcatagaaacatgaaataccggatgcacactcgataagctggatggcaaagcaagctcataagccacctccccaatcttccgaagcacctcaaaaggcccaatgaaccgcggactcaatttccctttcttcccaaatctcataacacccttcatgggtgaaacctttaatagaaccttctcgccaaccatgtaggacacatcccaaaccttcctatcagcatagctcttctgtttcgactgcactgtacgaagcctctcctgaatcaccttcaccttttctaaggcatcctgcatcaagtctgtccccaatagcctagcctcaccaggattgaaccaaccaactggagatctacaccgcctcccatacaaagcctcatatggagccatctgaatactcgatcggaaaccgttgttataagcaaactctgcaagcggtagaaactgatctcatgaccctccgaaatcaatgacataaacacgcaacatgtcctccaatatctgaatagtgcgctcggactgtccgtccgtctgagggtgaaaaattatgctcaactcaacctgagtacccaactctcgctgcatatacctccaaaactgcgaagtaaagtgagtgcccctatctgaaatgatggaaactaggacaccatgcaactgaacaatatctcggatatagatctctaccaaccactctgaagaataagtggtacgcataggaatgaagtgcatgtacttggtcagccaatccacaatcagtcaaataacatcgaacttcctcaaagtccgtggaagtccaactacaaagtccatagtgatcctctcccacttccactctggaatatctatccgttgaagcaagtcgcccggtctctgatgctcatatttcacctgctgacaattgagacaccgagctacaaatcccacaatgtctttcttcattcttctccaccaataatgttgtctcagatcctaatacatcttcacggcacccagatgaatggaatactgcgagctatgggcctcctccataatcaactcccaaagcccatccacattaggcacacaaatctggccctgcatactcaataccccatcatcacctatagtcacatctctggtatcatcgtgctgaactctatccttaaggacaagaaaatgcggatcatcatactggcactctctgatgcgatcatataaagaagacggataaaccacacaagccaatacctgactgggctccgaaatatctaacctcacgaaccgattggccaaggcctgaacatcaactataagaggtctctccccaactggaatatatgccaaactccccatactcactacctttcggctcaaagcatcgtccaccacattggcctttcccagatggtacaataaagtgatatcataatccttaagcaactccaaccatctccgcctaaaattaagatccttctatttgaacaagttatggaggctacgacgatcagtaaacacctcacaagacacaccatacaagtaatgcttccaaatcttcaatatgtgaactatggcagccaactccaaatcatgaacgaggtagttcttctcatggggcttcaactgacgagaagcataagcaataactctaccctcctacatcaacacacaaccaatgccaactcccgaagcatcacaatacacggtatataaacctaaagctgatggcaaaactaatactggagttgtggtcaaagctgtcttgagcttctgaaagctctcctcacactcctccgaccatacaaatgaatcacccttctaagtcaacctggtcaagggcgatgcgatagatgagaatccctgaacaaaacggcaataataacctgccaaaccaagaaagctgcgaatctctgtggctgaggatggtctgggccaactctgaaccgcctctatcttcttcggatcaacctgaataccctcgctggacaccatatgccctaagaaagccactgaactgagccaaaactcacacttggacaattttgcataaagcttctcctctctcaatctctgcaacacaactctcaaatgctccgcgtgctcctcctgactacgtgaatacaccagaatatcatcaatgaagactatgacaaactagtcaagataaggccggaacacgctattcatcaaatgcatgaatgctgttggggcattggtcagcccaaaagacatcaccaagaactcataatgaccatattgggccctgaaagctatcttaaaaatatttgaatccctgatcttcaactggtgataacctgaacagagatcaatcttggagaacaatctcgctccctgaagttggtcgaataagtcatcaatgcgaggcaaaagatacttgttcttaattgttactttgttcaattgcctgtaatcaatacacattctcatagtgccatccttcttcttcacaaatagaaccgacacaccccaaggtgacacactaggcctaatgaaccctttatcaaggagtttctgaagctgctcctttaattccttcaactccgctggtgtcatacgatactacggaaaagaaatgtgttgagtgcctggcaccaggtcaataccaagttcaatatccatgtccggtggcatgcccgacaggtctgcaggatacacatcgataaaatccctcacaattggaataaaatcaatattgtgagtctcagcactgacatacctcacaaaggctagaaacgaaagacaacccttcccaatcatatgttgggctttcaagaatgagatcactctactgggaacataatagtcacaccttgccactcgatccgtggcacactcggtatagccaatgtgactgtcttagtgtgacaatccagaatagtacgacacggagatagccaatccatgcccaaaatgacatcgaaatccatcatacacaataacaaaagatccacacgggtctccagacccctaatagtcaccacacatgactggtacacacggtctacaacaacagtatcacccaccagggtagatacatgaacaggtgaagcaacaaactcacggggcgtacccaaataatgagcaaagtatgatgaaacataagaaaaggtggaaccgagatcaaataatacagaggcatatctgtggcagactgaaacaatacctgtaataacagtatttgaagcaatagcattgggtcttctcgaaagtgcataaaacgggtctgaccaccacctgatcggcctcccctctctagggtgacccctagctgattgggcgggtggtggtgaagtaacttgcgctgaagccgatgactgattcacccgcacgccttaaactggaaccaacatagcacataaccgtgcaatcgaccaattaatagtggaccccccacttggctcaaagccatagatcaaaacataaacaataactcataacacatatgctttattgtttccataataccctagtgagattaaactcaacccttcataagctcgtggaacacagaccatctggtactttatatcttctacaaatcttgcattcactctcatagtagtcaagccttctctcttgagcaactcaaattcaagttgtaaagcatatacttccctagtaacagagatcttccaataaatgacacaagggattacgcaaacttcaaaataatccgcaagagataaccccacctgctttgcctcaaactaacatttctgtataccttccaccgtcataaacattacgcaatcacttaaacttcctgagtctgaactcataccgcaatatgaaatttactccactcctaactaggaaacatggaaagattcttcacacacacataactcggggctatacctcaaatcaagatgaaaatcgagcacctaatagtccttctatcatctagcagacccttctcgttgcttccaaatcacatgaatacatctcgcagtcacatcacactcatcacaactatctagtcatcacctcccttaatagggacacaatagacatatggatccagaaacacgcacttacgaaatcaacagctcaaggctcaagctataggcaaaaatttgtccttgagtcctctagactagcccaacatcaatgcagagagatcacatctctcccaatcataatccatcgatgcatatccgataccgagcgcacatgcgcatatactaacgcgtggaaagaattcaaagagttacttttcaagctgaatcaaggacacacgagaagaattcaagaatgtgaagtttttcttaaaggttatccagcttctcgaggataaatacagacgtctctgtaccgatccgcaagactctactaaacctgctcatgactcgtgagacctatgtaatctaggctctgataccaacttgtcacgaccctaaacctggatccgatcgtgatgtcgcctctcgtgaagacaaggctagatagttaaacccatttccatttttacacagttaaacaataagaaacagtctaagcatgaataaataaaccaaagtagcagatgatattataaatatgtggaagaataacccaacacaactcaatatcggggtgtcactagtcatacgcatttataagtcataatacaagtctgctaagtctataagctagtacaaatgtctgaaaagagatagaaatgataaaggaggagaaacacaagactgcggacgtcaagaagctacctcgtggactacgatatctgtcgggagctctcaactcgtactagcaggatccgcaatgcctgaatctacatataggggtgcagggagtaaagtgagtactccaactcagcgagtaacaaatgtaaataaagactgaaagcaagaaatcacgtaaggcacaaagcattctataatgaagcagtaaaacaattaaaacagtaaaccggtaaaagataggtaaaaatctttaacccaaaagtagtttcatgaaaagcctttttcaataattaagtaggtaattgacagtcaattgtgaaaagtaaacacataaagtcccgcccatcgggcacagtatcaacaaatccgcccctcgggcaatatcacagaacagtaccagcccctcgggcttaatctcacatcacaaagggtacctgcgctcactaggggtgtacagactcctagaggggcccgttacggcccaagcgaaatatcaagccacctcgtggcatcatcactaggaccccgacctcatatcaatcaagacaccttgtggcgtacatatctcaggccctcggccttactcagtcaaaaatcctcacaagccactcgggcagtagtaaaacatgtttttcagcccaaaataacatttaaaagatcatgtaattgttaaaatagagtaaacatgactcagtacgaaaaatagataaatataacatgactgagttcaagtataaagtcaaaacagtgaggaaataccagtaaaaatcccgaagggttcaaatagttggcactaagcccaaatatggcacttagcataaataatgatgatagcaaataaatttcagtcaaatacgcggtaaaaccatcaatcgggatggaccaagtcacaatccccaatagtgcacgaccccacgctcgtcatcaagcttgagcctcacctcaatatagcactacaatgagcaatccggggtttcaaaccctcaaaacatcatttacaatcattactcacctcgaaccggtcaaagctctagctcgcaactcctttccccccgaatcggtctccactcacgtcgaatctatccaaaatcagaacgacgatgtcaaaatatgataagggaacgaagcccaagcgaaaataatcaaaatacgacagaaatcccaaaataaccaaaacctgacctccgggcccacatctcggaattcagtaatttttacattaatagattccttatctccccacgagttcatacatatcaaaagttctgaaatctgacctcaaatagtgcttcaaattctcaatcaaaagtctaaatttccaagccctagtttccccaatttttacccttaatttccatgatttctagctctaatccgtgaaatagtagcataggaacgaattttaggtccaaattccttacctcaatgatgttcccttgaatccctttttcaaatcgtccaaaaaactccaaagccgagataaaaatggtgaaattagctaaaattcgcgaaggccacaatttatactttttgcccagacattttcgcatctgcgactatatttccgcttctacgatactacatttgcggttcttcctccacttctgcagaaatcacttattccccttagtccgcgtctgcggtcccctacccgcatctgcgacatcgcagatgcagtcctcttagccgcttctgcggttcctgctcctcaagccattttcgcttttgcgatcaattcctccgcttatgcggcacggcacctgcggtcccctatccgcaagtgcaaaaataccagaagcagcaaattcagcagctgtaacgaagtccaaacttctccgtcaaccatccgaaatcaccccgaggcccctaggacctcaaccaaaagcaccaacatatcccaaaaccttattcaaacttgtaccaaccatcaaaatacctcaaacaacatcaaatcaaccaaaacgcatcgaattcaagcctaattttccaaaatcttccgaattttgcttttgatcaaaaacctaaccaaaccatgtccgaatgacctaaaattttgcaaacacatcccaaatgacacgacggaactgttacaactctcagaattccattccaacccctatatcaaaatctcgcctatccaccgaaaattgccaaaatatcaacttcgccaattcaagcctaaatctattccaaacctctagaactcattccgatcatgcttctaagtcccaatttacctatcgaagctatccgaaccatcggaactcacatccaagccctcttgcacatagatcaacttccggttgactggaaatggacttttgagtaaacgtccccaaaatgggttttatgtgatctcaacagcttcatattgtgattttggacttaagcgtccgtctgaattcaaatttggaggtccttagggtaatgaggggtttcagcaaaagttggaaaaattgaagtttggaaagtggagacgtttgacccatagtggacttctatgatatcggggtcgtaatgtgaatccaaagttggaacagctccgttatgtaattttggactagtctgcaaaatttggcgccattccgggttgatttgatagatttcggcacaagttttcgaagttggaagatttggaagttcatagtttgattcatggtatgattcatcatttcggcattgtttgatatgatttgagacctcgagcgagtctgtgttaggttatatgacttgtttgtgtgtttagacggggtcccgggggctcaggtgtgttttgggtgtgttttggatcattttgggctactttggatgctgattatctgatatctggtattgttcttcgcgttcgcaaggagcctctcatattcgcgaagaagaatttggcttctggaagtttgttcttcgcattcgtgaagatactctcgcgttcgcgaagaagaaaatcttgattgcacaagtctgaattcagaggctcatatctcacaatttataaagaatttggagatgatccaaaaatgaaagttttagcctttgtgtctagttttcggaaatgtaaattaattggcatttagatttgtgtacaaaaattgatggtagttacactacaggctgcccgggagagtttgaaattctctactgcataggtttgaatttggaagcttatatctcaaaatatataatgactccggaaatgataaacctatgaaactatagcccttggtgtctagttttcagaacatcaaaccacttgtcatttggagatgtgtgaaaaacgttatggccattatactaaagcttgtctggaatgagtttggaaatcgctgatgaggaatttactcattgtgaatgcgagagaagggtcgcgaacatgaagaacaaaccctgggcaggcagaatatattcccaaatcaagggttagaccattttattcatatcttgacttgtgaagctcggttttgagtgattctttgagggtttttcacacaaatagattggctaatttggttagatttgagccgttcggaggttttttcacccgagaagtgcattttagagtatcggtttgtcatctttgaggtaagtatcttgcctaaccttgtgtggggaacttcctcttaggatatgagtctgttatgttgattgtagttagtgtacgcgaggtgacgagtgcgtgctcggacttatttgtggaaaaattggccttttagggttcttaggtccttatattcattgtgtatgaatgtgtacttgatatacttgagttttacacttattagtttcacctctacatgctctaattggaattaattgcatatgatttattcttattgcctatttgactcttattttgcttaactaaagatttttacctcttctattgttatgttatctttcataactgctcgtctttattggaaatcattattatctcccccataattgtttagtcttaattgaggttatgattatctttccgttgctcatccttaattgaaaatattgtatattcttcgtaaattgcccaaccttagaagaagtttagatatcctatatttagttgacatttccttatttggatttatttgattcgtgttagcttccttgttgttgaattacatattgtcggatcgttgcttcatattattttctcccttgttgggctattcttattacgcttagtattctctattgtggttattccttgtgagctagttttaccgtcaccttgtgatcgaaagttcttgtgttgatttacttatcgtgttcttgtatatattgtcattgttgttgttgtatttattgtggtggtgcatgaggtttctgcagtgcaattgttgatattgtgatgcgcgaggtttctgtcgtgcagttgttattatgaggttgcacgaggtttctgtcgtgcagttgttgttatggggttgcacgagttttctgtcgtgctattgctactattgatttattggacatgcagtgtgacaaggcggggtatgtatatatatacttgtatgtgggttgcgcatgtggcgagacaaggtgggaacattatgatgcatgtgtggagaaacaaggcggacacttattgtgttattattttcacacatggtgagacaaggtggtctatgtcagggattgattgtgatgatttgtgatggcctgggggcattcttgttgtttgatattgtgttgtggtatgcttacctgtatgatctttatctcgtgaaagttgtgaggaaacatcttgcgtgatgtccgttcttttccttatgcttattagctggtaagaactatgttaaagcacttgcacaagcatacacgtagttgaacactcctgttggatgtgaagtcctcctgattttgctgagtatagatgcacacccttgtttacttgttatatatgtgagagtggctctagttagcaagtgagttgtcagcatgactatgaggtgtgatgggggcacaggatgccaagtgttagatttcaggtactgggactcgtgagctgtaatttgtccgagattcggtatttcgtggaaattgttggataagacctgatgtgaacactgtcgtaggatctaagttattgcttacctttactgtattgtgaatttaggatttgggtttgtgtttgcgctcgctcttctatgtcattattttggtatttccactattacttgctattttcttcccttattatgattgtagtattgttagccatttcgtgtagtctttatatatatatcatgtttcgttgttcctatatttgtacagtttattggactggtaggtgtcttaactgttcctcgtcactactccaccgaggttagtcttgatacttactgggcaccgctgtggtgtgatcatgctactcttctgcacatttttgttgtgtagatccaggtatcgatcattagtagttgtgcggatcattgctgaggaaactcaaggtaaacttgttgcttcgttcgtaggttttggaggcaccgtcttacttgtattaaactgttttcactcttttccaaactgttatatttagaagtggtagataactctgtagagcttatgacttgtactaccgggttttgggaattataaatttttttgagatttctacttcaagactgttaaatgtcatttattattgtggtatttcagtatgagttaggcttccctagtccctaagactaggtgccatcacgatacccaaacggagggaaagttgggtcgtgacatattcaccattgatcattgtgtacctgtgaaaatgagccttgagtctactatggtttaaaggcctgggttgcccgggtgtatttgggcctgttgcaggctctctatagttttacttaccttttgtaatttgtttattaactctggtttgtaataattattgtaataacaattctggggtatttagtaaattgggaagggtttcttattttcatttgcaaagtcaggtagaaatcctgcctatagggtctctatttgtgctgttaattctgcttataagttccctattagaaatcctgcctataggttctatgttgtgtttacatgtaagaaatcctgcctataggactgacgttatgatttgatgaaaatcatgtctttaggtgtatcaatctgtccaataaacgtgtgttagaaatcatgcccataggatcaatgtttgtcccaattgttttctggctcaatgtgtataaattcttgctcatatactgctcaattcaagaaaccatgcctataggatttaacaataattttggacttgtgatttactgttgagacgcccagatattatactgaattaaaatcggtaggcaaatatatgtaggccctagcacttgcatgaagaaatgtctctgcatgctactactcgcctgttcatcacatagatatcctgcctatagggctctaagattaataaagcctgctaaatcagttatgtgcatttgttgttaacatgtagaggttaacatgagcccatacctgtctttatttgaaaagtcctaattgttttgcttgtcgattagtattttacaattttgagaaccttagtcctagtctataactttactaaatagaggtcccatgcctccaggatcttaggtaagggacggctagtgcacgtataggacacgggttagaattaactagagcactttaggtaaaaactcaaagatagtaatcaagtagcagaagatgatagcttgtgcccgctggataatatgagtaacacccccgtcttgggagagttacgaagtattatttatgttgcatggggtgatcctataggctaaataatttaggaccatcatccttattgatatattatttgcttctttagactaattcgcataatttaagttcgatcgagacctaccgttatgaacctcgaggggtgcctaacaccttcccttcaaggtaatttgagcccttacccgatttctgatgatgcaaactagtataatctaagttatttgttatagtttccctaacgcgccttaatccgttaggtggcgactctaacaaccaattcctttccctactctctcaaaaggagttgtcaaaatgtcgaaacccgtttttgcgagaaaaagggggtgcaacagaatggcgactctggtggggatatctttaagctcttaccacaacgacttgttttgtgaattagtctttctcaataaggatgtctttgttattctgtttatacttgcgcacacctttccctttccactctatatgaacttatttgccttccctcattcaattgtgctcactaaatttcttctttttgttttattgcttttttactatggaaactaactcttctccttgttttctttcttaaacacctttgcaattattaaatactgaattttatcattctcatcgtgtaaatacttgataacgtgttatttttctttttgcttaaacacatgttcaacattatattcccctcgtgcataattaataccatagcaacacttgatgagtgtctgcgctcttcctgtatcaccctgttgaatttggaaaggcttatttgcagtaaaactagtcgatcagcgatgcaatcgatggttccgtgcctttcccccccttcctccccccccccccaagttgtccgcttgggggtactaatctagacttctatagaaaccttactatgataataactacacatgcatcatgatcaaacctatcttgggttaataaattgtccgcataataaccctctaagaaaaaccttatccaaagtccaccagaatttccataatcccaatgggctcaaccacgatatgtgcattatttggagagataaatgctgacatgctaatcattaatgtataagtagtcgaatctggagcgggaaagggtctaactctgtttattttgcagaaaatgagtcacgaagtccccaggttcggcatggttcgaaatataccattgttattgctggattggtgggaaaaccttttgccaagcgacaaaaatcacgtgaaaagggttcttggaaacttaccctccttattggacatccagccaaacaacatgctaatcgaaactgctactatgttctgggatggagaaaggactgtattccgttttggtaatatagaaatgaatcctcttttagaggaaataagaggatttgttggattaccctgggatagtcctggtttgtttgtgctagaaaatcgcacttccagggggtttctgaaaatcatgggtctgagagagagtgacgacttgtcatgcctgaaaaagtcctacatacccttcaacttcctctatgaatgatatggacacagcaaatcttactgtatttttcatgacgaattctccatcacttccctgggttggactcatcatagggttttcgtattcatcgtctgttttctgggtatgatagtgtttccaagccaaggggacatgattcacaccaggttggtcatggtaaccaaaactttaatggagggaattgagggacaaacatatactactgttccgatgattgtagcagaattataccaggctctagatcgttgcaagaaggggttcaaacattttgatggttgtaacttgttgctgcagatttggttgttagaacatcttcaaagagtccaataccaccaagagtttcaacggagaccatggaatggtcaaatagctttccaccatctaaaaagaatgacctttatcccagacatatttgcacaaccaaagaatgctacagaatgggtacagtttttcaacaatttgaccgaggccaaggttcattggatgttcgagtggttccctactagcgaattcatcatcagatccagggatgttccgcatctggtgttgattgggttaaggggaatatatccctatgttcctatcagggtcatgagataggctggtagaaaacaactcataccgtgagtctccaaaatgagtcattatgaagcaaattttcaagatgacgcgattccatacaaatgtgaggcccagcacatatggcatttgaagattatcgtggaaaaggataccatcgagccagatcgatatcacgcaggtcatatgtacttttacccatcatgattggaagatagcatagcaggaatagttgatccaggggttggtcaaggaaacagggtcatagatgaagttgctgaagcacaggtgaagtatgagaggctacgcaaaagagttcttgagtctgagtccaggcatttggaaaaacacaagatagacatggattcaattaacgagtggagggaaatgtctacaaggtcgacaaaaaggttggaatatttggagcagggtctaatggaactggaagggaaaatgaggaaaaaggtcgtagattgtcagaatgcaaagggaaacgaaggaggacacctagcaagggcatatctgttgcgggacatgcatgacctggggaatttgatcgacggagccaagagggtcaagtatggagaaggtccctcctggaccaagtagattaggattatctatttttttgaatcgttttggaattcgaatgtgataaggcagatgtcattagtaactcatttatttattaccatttttaggttcgtcttatttagtacattaatgaaatgagacatttatcggcattaaatttcttcaaatctacttgtcgctaggcctacctcgtgcacaacaaggttcccaaattaggacgtgaacttacattcctgcaatatgtgtttaaatactacaaatacttttcagaacccttactgacttgtttatatttttattttttctttattttgattatttttattccctaaggttggttcgcacatactggcatcgccagcatatcacaccagatctacaggcccctccacctcctcctcctctaagtaatccgaaaagcaagggaaagcctaagatggatgatatgagttgtatccggaaataaaatgttgtgcacgtagagaatgttgaaacttcagacggtcggagtactccggcacagaatgatttggtcctacagttggaacagaagatactagaattgcaaagggagcttgagcaggtccgcaacctggcaaacctttccctcaccctaaatgtcccagacattaaccaacaaaatgttcaaaacctagtaccttatcaaaaaacacaaaaccaacgtccgcaaaatcctcccgcaccccactaatatgcaacaccaccccaaaatcctaatcctccaccagtaacaactccccctcaacaccagtatctcccgactcaatacccacaaaccacttatcatacttctcataataccccacaacctatccctgatccgcaaaattcaactaatgatcaccactacactcaaaccctcggcacccaccaaaacaatcccatatatgtggaaaacttaccctactccactcaaccaatctcatacacaccagaatccaccgagaagtactttctcattaagaatatggcggaggagctcaagaagctcacaagcagagtccagggtgttgaaggaggcaaaggaaatgaaggtctggattatgatgatctatgcattcagccagacgtaaaactgtcggagggttacaaatctcctaagttcgagatgtttgatggaacgggtgacccgaaggtacatttgagaacatattgtaataagctcatgggagttaggaaatatgaaaggattcgcatgaagctgttcatgaggagtctcactggagatgccctatcttggtacataagtcaaaatcccatgaaattggttaattgggtaagcatggaattagaattcatggaccgattcaggtttaacacagagaatgcaccggatgtttacatacagaacctcaagaagaaaccgatggagaccttctgcgagtattttactcgatggaggtcagaggctgcaaatgtctgaccggcactagaagaagagcagatgaataaattcttcgttttggcccaggatccacaatactatgaaaggttaatggtcaacgaaaatcacaaattctccggcattatctgtttttgaatcgttttggaattcgaatgtaataaggtagatgtcattagtaactcatttatttattattgtttttaggttcgtcttatttagtacattaatgaaattagacgtttatcgacattaaatttctcctaatctacttgtcgctaggcctacctcgggcacaacgaggtttccaaattaggacgcaaatttacattcatgcaatacgtgtctaaatactgcaaatacttttcagaatccttactgacttgcttacctttttgttttttctttattttgattattcttattccctatggttggttcgcacatactggcatcatcagcatatcacaccagatccagaggcccctccacctccacctcatcctccaagtaacccgaaaagcaagggaaaggctaagatggattatatgagtggtatccggaaataaaatgttgcgcatgtagagaatgttcaaacttcaaactgtcggagtactccggcacaaaatgatttggtcctacagttggaacaaaagatactagaattgcaatgggagcttgagcagtttccctcaccctaaacatctcagatattaaccaacaaaatgttcaaaacctagtacctcctcaaaatacacaaaaccaacatccacaaaatcctcccgcaccccaccaatacgcaacaccgccccaaaatcctaatcccccaccagtaacaactccccctcaacaccagcatctcccgactcaatacccacaaaccacttatcatactcctcataataccccacaacctatccctgatctgaaaaattcaactaatgatcaccactacactcaaaccctcggcacccaccaaaacaatcccatatatgtggaaaacttaccctactccactcaactaatctcatacataccagaatccaccaaaaagtacctgcttattaagaatatggcagaggatctcaagaagctcacaagccgtgtctagggtattgaaggaagcaaaggaattgaaggtctgtgttatgaggatctatgcattcagcaagacgtggatttgccagagggttacaaatctcctaagtttgagatgtttgacggaacgggtgacccgaaggtacatttgagaatatactgtgataagctcgttggagttaggaaagatgaaaggattcgcatgaagctgttcatgaggagtctcactggagatgccctatcttcgtacataagtcaaaatcccaagaaatgggttaattgggtaagcatggaatcagacttcatggaccgattcaggtttaatacagagaatgcaccggatgtcttctacataaagaacctcaagaagaaatcaacgtagactttccgcgagtatgctactcgatggaggtcagaggttgcaatggtctggccggcactagaagaagagcagatgaacaaattcttcgtcagggcccaggatccacaatactatgaaaggttaatggtcatcaaaaatcacaaattctccgacatcatcaaactcggggaaaggattgaagaagggatcaagagcgggatggtaaccaatttttaggcattgcaagctacgaacaaaacattacagtcagggggtatatcaaagaagaaataaataggggtagtaatggtagcctaaggtctataatctccattcatataccaaacacttccacccacataccaaccttcacccccagatatcctcaacccgctaccgcctactacacttataacacccagctagcctattatcattcacctccaacctgccaaaactataaaaaaaaactcagacccaatttcgatcacagaccacccagataatacacccctatttctgaacttatcgaccaactatataaaagaatgaaggctgccggatatgttacccctattcctgctgttccatagaaaactcctcctagtgggtcaacccaaacgaaatatgtgcataccattccgacatgaatggacataccattgatgaatgtcgcaccctaaaagacaagattcagaccctgattgataccaaagtcatacaagcaaaggaagttgcacccaatgtccgcaacaattccctcccagatcataggggtgaaggagtagatgtgatagaaactaatgaagaatgggatcctgaagggttaattgggcttattcaggaaggtaatgaccctaagaaacatgcagtcacactcactcctattgtgttacagatacagtcaccagtcaaagttgaggtagccgcatcaactccgtttgaaatagaagtgacagcacctacaactacacctactccatttgaagcaaaagtatacacacctttcattgtgacggtggcatccacaccacctttcaattccaatgtcgtaccttaggattatgttgccgaagctaagaaaaaagggaaagcaaaaatggaagagtctggtgctgcacaagggatgaccagaactggaaaaatctatacacctgaaaatttgggaggaacaagtaaggaggctactgccaaacaacctatcattgaaactagtccagatgacctctagaggaaagtacaggcaagagaatactatgttattgatcatctgaacaaaactcccgcccagatattcatcctgtcgctgctacaaaattttgaggcgcataagaatgctctgatgaaagtgttgaatgaagcatatgtgcccaacaatatcacctgtagagaaatggccaacatggtggggcaagtgttggaaagccacaagatcacttttcacgaagatgagttgccgcctgagggattgagccacaatagggcactgcacataacagtgcaatgcaaggataagttcattgccagggttttgatagacggagggtctagcctcaacatctattcactgacaactctgaaaaggttgggcaaggatttgcataaaatacgagcaggaactatgaatatgaaggcgttcgatgggtcgcaaaaagccaagattggggaaaccaatttatatttgcagatgggtcctagttggtttgatttcgaatttcaggtgctagacatatccgcctcctataatctgttgttgggacgaccttggatacatgctgttggggatatcgcatccactttacaccaggctgtgaaatttgaatggaatcatgaggaagtaatcatgaaggagatggaagcaatcccatttgtaccaaccaaactgttccgattgtggaaaatagaaggaagttaggcggagagacttatcaccatatcgagcgtgtcaatgcaattgagaaagataaatggtggagcagtaaaatagaaagcatactggcatggttagggtatgaactcggcaaagggcttgggaagaaactccagggcattaccaaaccaatacagctaaaacgtcatggtacaacttttgggcttggacatccgtatacatggaaataatataatgattggtcaccaccatggcgcagtccctattaccctcttgagcagccagtgtcgcatctgagtcagaccttccgtcatgccgatccaaagaagaagaagctttggttgggctaaggaatctgttcttagaagacgaagatatggattgtaatgtgattgttgaggaggaggaggaggaagaaggccttatcattcagatagtggagagcggagcatttcttaggaaccggatcgccacaccgtccaggaccagaagagtcccgaggtagcacggctactaatgttacttgaaaaacaagtcttttgagcatttcattttaaaaacatctttctttcagtatttttttatggaaaacattgttttgaagtcatctagatgatattttgcttaacgtttcagcatttgtcaaataatttgatgttttattatcgttatctttcatattttcttcaatagcattactatttcttaccttgatgaaccaacgactgtgatatgtaatgagagaacgcaacataaggatagtgattcggaagaagaagatgagatacctgaggaagttatcagataagttgagaaatttgagaataagcctaagtccaacctggatgaaactgaaatagtcaatttgggagattctgaaaccatcaaagaaactcgcataagtattcacctgtcgccatcagagaaggaagaacacttatttcctaaaagaataggaggataatttttcgtggtcatatgatgacatgaccggtctgaacacatccatagtggctcatagattgcctaccaatccaatgtgtccgccagtgaagcagaaacttagaaagttcaaaccagacatgagcctaaaaatcaaggaggaagtcactaagcagatcaaagccaaggtcctcagggtagttgagtacccaacctggttatccaacattgaacctgctccaaagaaatatgggaaaggtagggtgtgtattgactatcgggatataaacagagcaagtctcaaggatgatatcctactactaaatatatacattccgattgataattgcgccaagtatgaaatccaatcctttgtagattgcttcgcgggttatcatcagatttggatggataaaaaaaacgcagagaaaacagctttcattacaccatggggagtgtattgctacaaaatgatgactttcggtctgaagaatgctgaggccacctatatgagggccatggcgaccatcttccatgatatgatacacaaggaaatagaggtatatgtcgatgtcatcatcaaatccaagaaagccacagatcatatagtagacttgaggaagttttttgaccggctacggaagtacaatttaaaattgaaccccacaaaatgtgcattcggggatcccgccggaaaattgttgggatttatcgtcagccgctgaggaattgagttggacccgtcaaaggttaaagctatccaagaattaccaccaccgaagaacaaaaaggtcgtgatgagtttcctgggatacctcaattacatcagccgcttcatagcacagtctacagtaatatgtgaaccaattttcaaaatgctgaagaaggatgttgcaaccagttggaccaaggattgtcagaaggcttttgacaaaatcaaggaatacatgtccacacagccagtcctagtcccgccagaacctggtagaccactactactctacctctctgtattagatggggctttcgattgtattttgggacaatatgacgagacgggaagaaaggagaaagccatatattacttgagtaagaagttcacacattatgaagcacgacactttttactggaaagcacctgttgtgctctgacatggacaactcagaaattgaggcactacttctgtgcttataccacatacctcatatcaaggatggatctctgaagtacatctttcagaagcctatgcctaccaggaagctgtccaagtggcaaatattgtggagtgagtttgatatcatcgatgtaactcagaaggcagtcaaaagacaagcattggcagatcatcttgccaagaatcctgtaggaggagattatgaaccactaaaaatgtattttcctgacgaataagtgtcattcgtaggagaggacatagctgaagcctactacggttggagaatgtttttcgacggagctgcaaatttcaaaggagtcagtatctgagccatatttgtatcagaaatcgatcaaaactacccggtgtccgcaaaactcaggtttccttggaccaataatatggctaagtatgaagcctgcatattagggctcaatttggccgtccacatgaatgttcaggaattgttggtaattggtgactcggactagttggtgcaccaggtacaaggagaatgggctacgaaaaacaccaagatactgccatatctacatcacgtacaagagatgatgaagaggttcacaaagatagagttctggcatgtccccagaatccagaatgaatttgcagacgcattggccaccctatccttaatgatacaacatccaggaaagaatttcatcgatcccatttcggtgagggtccacaatcagccggcatactgtccccaggtagacgaagacagatgggaatccatggttccatgacattaaagaatatttggcaaaaggagagtacccagaacaggcaaaccatactcaaaaatgcacattgtagaaactgtccaatcatttcttccaaagcggaggaattttgtatagaagaacactaatctaggactattaagatgtgttgacgccaaagaagctcccaaattgctcgaggaaatacatgtcggaaccttcggcccacatatgaacaattttgttctagccaagaagatactcaaggccggataattttggataactatggaaacagattgcatccggtatgtccaaaaatgccaccaatgcgggatacatgcaaatatgatatgggtgccgccaaacaaacacaatgcaacaagtgcaccttggccttttgctgcctggggaatggatttcattggtctaatcgaacccactacttcgaatgggcacaggttcatttagtagccatcgattacttcactaagtgggttgaagtttcatcctacaaagcggtaatcaagaaattcgtcgtaaattttatcaaggatcgtattgtttgtcaattaggggttcccgagtccatcatcactgacaattccgctaatctcaacagtgatatgatgaaaatcgtgtgtgaaactttcaaaatcaagcacaaaaacttcaccgcatacaaacctcaattgaacggagccgtggaagctgccaacaacaacatcaagaagatactaaggaaaatggtagataatcacaagaaatgcacgagaacttaccatttgccttattgggataccgtaccacagtccacatatcaaccggggccactccctgtttgctggtttatggtactgaagctgtcattcccgccgaggtagaatgaatttttcctatgagcaattagccctcatagatggaaaaaaggatgaatgcaccgtgtcatggtcagctttatcataacagaatgtccagagctttcaacaaaagggtcaaaccaagacagtttacaccggggcagctggtgttgaagcggatctttccacatcaagatgaagccaaaagaaaaaattcacttaactggcaaggtccttacatggttcataaagtattgataggaggagcactcatactcgcagaaatggatggagaattccggccaaagcctatcaatttagatgcagtcaaaagatactaggtgtaaactatttatgtttcttcatatgatgtaattgaactatacttgacctgattcccatttaagagggtatatgtaggcagccccgtgggttcggtcacaattcaataaaattttcattttccctacaatcaaaactggggcagaattttgaggaggaccctcaaaattctatggcaaagaaggtcgcaatgtctctaataacgtcacagttactagttcatctaactgatttctaatttgcatatttctatgtctttgaaaaccatacacacatactttttgtaaagaaacttttctagccaagtgctacccatggtgacttgaacaggatcctcgggcagaacggagcaaagcaagcagacaaaggcacgaaccaacctccgccacaaaactcacaaactttctttggatgcaggaataggtcatcaccataagcatcgtcacgacaacagaattgctatgcataaacatattaccacctaagaatacttcactattactcttacatttacatgaggctaagctatgcctccctatttgcataaggctaagcattgccttctcttttcatgagactaagctttgtctcaactcttgcatgaggctaagccctacctccgtgtttgcataaggctaagcattgccttctctttgcataagtctaagctctatctcaactcttgcatgaggctaaccctgcctccctatttgtataaggctaagtattgccttctccttgcatgagactaagccatatgtcgattcttgtatgacactaagctctaccttcctatttgcataaggctaagaattgccttctccttgcatgagactaagacctatctaaattcttgcataacgctaagcccttcctccctatttgcataagtctaagcattgctttctcgttgcatgagactaaaccatatctcaattcttgcatgaggctaagacctgcctccctattagcataaggctaagcattgccttctctttacatgagactaagctctgtctcaaatcttgcatgaggctaagccttgcctcctcatttgcataaggctaagcattgccttctctttgcatgtgatgggtttcaatatctttgccttatattttgataatataacaaacttactgtccagaatcagatagggaacctaacacagttgggctataatgcaagttaacggatttcaattaaatgtgagctgctatagcttcaggagatagagaaccaaacaaggacatgatacccttgtggttcccttatagcagtacgaagtcaattggacacagctggaagcgacatgactacctgcactatttctacctgcattgcactgtttccagtggccacttatcttttgaccaactaaagtgcttacatcattcaagtgatgtcatcaaggtgtatcaacaaggagtttatatcaaaacatcacttgaacacttgcttttctcattcaagccttctgcaaaactgtgaaattaattctcttgagcttgaagaacaaagttaaatgctactacggaccagttcctaaaattagtattttgttgtccttaattgagttgtaactttgtgattgttcttattgtatctcctaaattgcttagctagaagcgttgattaggaaccctcttgtaaaatccgtaaactctatgagtttatattgtgactaggtttagtcataagttaaagtctttataactagagagtgataaagtggcttgtggtaagagtatcacaagttagttgagttgaattctttgtaatggagtcattccaaagtggcttgtaataggtttttacaagttattgaagttgaaagcctacaggtgtaagtcgtggtttttgtccccttgagttgggatttttccacgtaaaaatccggtgtcttatttacttactgttttatcagcattctcagtacaacctcatagaggaccaggtactttactgtttggtggactcatacaaattaacaattggtattagagcgggttcctcctattaggctaacacctagaaaggatccttatggctgctccaccaaattttgaagaaagtcaatctacatacagaccacccaggttcaatggacaatactacgggtggtggaagacaagaatgcatgattattacatggttgaagattctgagttatgggatgtcatatgtgacggtccttttgttccaacaaaggtactggaagaacttccattctcaatgccaaaaaccagtaaagaatacaccgacgtagataggaaagtggtggagaagaattttcgtgccaagaagattctggtatgtggaataggacctgatgaatacaattgaatctccgcgtgtgacactgctaaagagatatgggaagctttgtaaatagctcatgagggaactacccaagtaaaacaatctaagatcgatatgctcactaccgagtatgaactcttcaggatgaaggacgatgaatctattcaagatatgcacacaagattcactttcatcataaataagttacactcacctggtgaaaccatccctaggaacaaggtagtgaggaaaatcctcagtattcttcctagcctgtgggaaagcaaggtaaatgctattgttgaatcaaaggacttgcaagaactgaccatagaagagctggttggaaatttgaagacctatgagatgaagaggaagatagacagtgaaagaagagaaccaaagaaagaaaagaacctggtactcaaagctgatagcaatgactcaagtgaggaagatagtgacatggcttatttaaccaaaagattttggaagatggccagaagaaatggagaaatgctaaaaaggggcagctctagcaaatcaaaaaactatgatctctatcataagtgtagaaagactggacacttcatcaaagactgtcctctcttgaagcaaaaattatccaagtataactctgagaaagcagctaagaggaacccggttcctctcaaggacttcaaaagaaagagatctgttgacaatatggtgaaacaagctcttgcagcatggggggatttctctagtaagtctgaagatgaaactgatgttggtgatagttccataatggaagttgaaagcgaggaaaaggaatatgacctaacttttgctttgatggcccaatcagatgatgatgaagacaatgacaacaaagaggtaactttcaggtatgttcagaaaaatctgaaatcctacactcctaagaaacttatgtctttagctaatgtattgattgatacctatcataaccttgtagaggataaggatgatttgatcttagaacaaagggaagttgataaaaccatagatgatctggtagcgtgtgtagtgatctgaaggaaaccatttgtgagttgaagagagaaaaagttgtcttgaccaaaacgattgccaacttagagcatgaaagaaatgacttagtggtagtagttcttgaccataaggaaactattgagaactttagtgaagaaaaggaggccctagcaagaagagtgactgaaattgaggaagaaagagatgatctctttgtagaaattgtagacctaatggaaataattaagggactaagaactaagtctaaacctggaaatactggaaaaggaaaagagatagccagtgaagaacacattaggcctaaaaatgagttgaaagctatgagaaccaggatgtgttttgaaactaataaaaacaaacacctccaaactgaactgaaaagagtaaaaaatgatcttgaaaagtccctaaagtggacctggtcctccaaagctatcactgccatgaatactaataatggtggaaacatgcagggaatagggtttcaaagggagaaaaccccttacaacctacttagcaaatgtgtgactgtactcgaaaattggctgagtacccactatgggaacaatggacatttcatggaaaattgtcaaaccagggtccagttcactcaaaaaaacagaatggttgctgaaaatataactactaaaaagggaccaggttccactcacaaaaaacgcatattatatgcatggactaagagagctcttattcatcctcttgcctactacaagggacacaaacttgattgggttcctaaaattaattcttgatcttcttgtgcagggaacagtgaaaggaagcggtccacaatggttcatggatagtgggtattcaaagcacatggctaggaacaccatggactttctttcactaaaatccctacaaggagggagtgtatcctttggcaatgggaaaaatgggtacattcttggagttggaaaattcgggaagtcactcacacattctattaaaaatgtgtactatagtaatggtcttaagtacagtctcttgagtgtctcttagatctgtaataaaggaaacaaggtggaattcttgtccaagatatgtacagttactgatctggtaactggtgaagtggtacttgtggccaagagatacaagaacatctatgttgctgattttgagtccttacaaagtggtgatctgagttgtctgaaagttgttgatgatgatgctaaactctggcacagaagattggggaacccaagcttctctcttctgaacaaactaatttagaaggacttggtccattgtctgcccatgtcaaagttccaggtacaaaaagtttgtgatgtttgtgctagatgaaaacatgtgaagtcttcttttaagtctaaaagggatgtgatcagctcaaagccactcgagcttctgcatatggacttttatggtcctatgagagagcaaagcaggggaggaaaaagatacatttttgtaatagtggatgactactccagattcacatggactctgtttcttagaactaaagatgaaacatttgaggtgtttgtggcctttatgaagaaaatctaggtgaagatggagtgtagagtcacatgcattagatcagatcatggaacagaatttgacaatgccaactttgatgagttctgcaatgaaaatggcatcactcacaacttctcagctcccagaactccccagcaaaatggagtagtggaaaggaagaatagaactctagaagagatggcaagaacaatgctaatcgacagtggaattgcaaagaacttctaggttgatgaggtcaacactgcctgctacttggtgaataggtgcatgatcagatcaatcctaaacaaaattccatatgagttgctgaattgaaggaaacccaagctgactcacctaagaatatttgggtgcaaatgctatgttctcaataatggaaaggatcagcttgaaaattttgatgccaagaatgatgaaggaatatttctgggctactcttctccaagcaaaacgtacaagatatacaataagcggacctaatatgttgaggaaagtgttcatgttattttttatgagtcttatctatcctgtgagaagagtgctgaagaagatcaagatggagaacccttactagtccctggtgaagtcattgacatgacaaatggaaaggcagatatgatgagccaagtgaaagagctgagtgaagacaatacttcctcatcttcaatagaaccaggtacttcaattacaaccactgaagctgaagaaagagtggttgacgcagttcagggtattccattagcacctgagagaagaacatcgaaaaaccaatcaaatgtacccacattctctacaaatgaacctcagacgtctaactggagacacaaaagctctcatcctcttgacaacataattacccctctagattccagagtacaaaccaggtcaaaagccagaaattcacttgccttattagcctttctctccaaaatagaaccccaagaatatcaagaaagccttgaaagatgcaaattggattacaaccatgcaagatgagttacattagtttgaaaggaacaatgtctggcacctagtacctagaccctcagatcgaaccattatagggaccaggtgggtattcaggaacaaacttgatgaacatggaaataccacaaggaacaaggctagactagtagttcaaggatacaatgaggaggaagggattgattatgatgaaacatttgctccggtcgcttgcatggaagctattagaattctaatcgcttttgcatctcatatggaattcaccttgttccaaatggatgtcaaaaatgcttttctaaatggatttcttaaagaaaaagtctacgtgaagcaacctccagggtttgaatgtcaagaacaccctgattatgtgtttaaactagacaaagcattgtctggattgaagcaggctcctcgagcttggtatgaaaggctatcaaagttcctcttgaaaattggttttaaaagagggaaaattgacaacaccttgttcctaaagaaacagggaaggaactttctcattgttcatgtctatgttgatgatatcatttttggggcaacaactgaggctctgtgtgaagaatttgcaaaactcatgggaagtgagtttgaaatgagcatgatgggggaactgaacttcttcttgggtcttcaagtaaaacagtcctcaaagggtacattcatttgttagcaaaaatacatcaaagagctcttgaagaggtttgacatggaagcatcaaaggtgatagatactcatattgcgacggccactctactagacatggacgaaactggatctcctgtgaatcaaaccatgtatagaggcatcattgggtatcttctttatctcactgccagcagacctgatattatcttcagtgtggggctatgtccaaggtttcaatcaaatcccaaggaatcttatttgaaggctgccaaaagaattctgagataccttaaaggaacacaggacctggttctttattatcccttaggtaaccgttttaatctcattgaatatgttgatgcagactatgcaagttatcttgtggacaggaaaagcacttttggaatggctcactttctaggatcatgtcccatctcctagggaacaaggaagcaaaattcagtggctctgttaacaactgaagcagaatatgtagctgtagcatcctgctgtgctcaacttctatggattaagcagcaattggaagattttggggtacttactgagagtgtgccccttctatatgacaacaccagtgcactcaacatggccaagaatccagttcaacacaaaaggaccaagtatattgatgtaaggcatcactttctgagggacaatgtggagaaagggttgatctatatgaagttctgtagcactgaagaccaaattgcagatatcttcaccaaacattaagtaggaaacattttgaaagaaacagagtgaagttggggatgctaaagcccaattgagaaccctattcctcatcatttggctatgaaaatcaccttcaggtaaaacaagctaaaagttttttctggccaagtctaactcacttcaataccattgtacgtaaacacgcatgatgagtatagaagctgtaaatgcagtacatggatgataaaataggattgatactttcaaataacaggtcaagaacctagttcttgtaccaaatgtgagtagttttgtgcattctttaatacacatcttaaaaaggtacaaaacataactaccatgtcatccaccttttcagatcctactgtcacgtctcttcacttcaaattattccatctccctctgaaacgttgcactttactacgcacaaccgctatttcagaaccgatccctatctcactcttttcataattatccatcattaataaaaccctcttcttttctccacaaaccataagtcttccattagaacttcctagagtaccttcactccatcttttcaatggctgatacaaaatccgacatccctgcctcagtcatccctagtactaaaaaacctatggagtctgtcattccctatgagtcttttataaccactcctactctccccgctgaagtcacacctcacctagattccccgtctctctctatttcagaaacccctaaaattgttgatacgtcctctctatcttctgaggttccccctaatcaaagaacaagtggagaacaaggtcaaagccatgaggtcgtagagggttccgccattgttactgtagattttgtggtggtagtagtgctgattgaggaagaaaatattgtaactatctttgtggtatctgctgacggcatccttcatgagataatttattagagaaagaggtacaaggtatgggggaagaaggagccatagtgactgttgaggatgttgcactagcagaaactactggtccctcacatgaggcacctgatccctttccgaaggacccaggtcagggttttcattcctaggatagttctgctcctgcatttgctattgcgcctctagacattcaagatcctgagatgaggtccagtgatgaggaggttttagataacctggctcttgatgcattcataattaagagaagggtggtatccactcctgagtcttccaccaatagacctactactaggttgcaagctaaggtggcatatgactctgcccttcaaaagagcagaaaaagtagtaacaagcaaaggaggagattggtgaaagataatgtgcccatatatgataaagcggtccctgtagtagaagtggaagaggaaacaccagaggaacctggttcattggtgagacggtcccagaagaagaagaagcctacttcagtaaagaaaggttcaacccccagttccaagttgaaggatgttgtgagtgagtcctcgatgtttgatgaggatgcgttaatcaagtttaagggaaaagagaaatcaagtggtgggaagtctgacaaatgcaagtctgaaactattcaggaacctagttctctgaagatactgaggagtgaaggcagttccgtttcagaacacctaaggcaccaaaaggttttgttgggtcgtacgtttgacccagcaatctttgagatggctggtatgcgataagttcttaaaatggttgagtttcaattatgggggcatctattccaaatagatgcacctaaactgtatgaggatgaggttcaaagcttcttttctagcctctttcccattgagaccgaccacatttgtgatttggtgaatggagtagatatcgtgttcgatgtaaagtttattggggaaattcttaaagtccctacagttggtgtgaccagtgtgaaggatgtgtgtcactataatttccgaaatgtcgtggtaaaagacaatgtgaaccaaaagggggaccagatccacaagaaggcattactctttgtttatcaactacttttcgaataggtaaacaaagttctattgcttcgtactgagaggaggtccatcacttctaagtctgacctatttttgatggagcaactggatagctttactctcgtaagcctgcctgttattatgattgaacacatgcaaaaagtagcaaccttcaaggatggtaatcatggccttccttacggtttctgcttacgcgagtgtttaagtttttcaaggtgtcgttaggccaaggcaacgtaggaactaagaaacatactttctcacagacaacgttggaagaatacgagtgcatagaaaagaatggggggtaggaagtacatcaaccgtctcacagctcattaatgctcaaaatagtgcaattgaggagattcgccagttgaaggctaggaatgctatcctggaaggtcagcaagcccaaggggttctggcgtcaaacgatgaagtagctcatttgacaaaaacgaatgctgatctcagggcgcaagtagagaacctgaaagcagaactgctcaatgagcaaaagtcggccaatactcgaatagacgtagttctccaaacacttgctgcagccttaagccctctactcctagtgccccctaagtacccctttagtgaccaatttctggaatgttcttttaagtttttttttagcatagttttgttttctttttttgatatggttgggattacacagcactgctctcgtctttaacagtccaattttacctttgctttttaagcaaaggcttatatttctattaatataaaatctatcctcttttgttatctcattgcttgaattttctaattctcttctctatcatgttgtgtgcacatatgtggcatgacttagcttggctagacttctttgtgatgtttgactgcatgtgtctttttaatgatgccaaaagggggaagtaatatttaatcaaggatctgattaagggggaagtataaagtcagagagaacttgtgaagttcatgttactttatctggttctctctactttaaatacgtgttatcattgtctcagtttgtcatcatcaaaaagggggaaattaatgggtttcaatatctttgccttatgttttgatgatctaacaaacttactgtccagaaccagatagggaacctgacacacttgggctacaatgcaagttaacggattccagttaaatatgaactactatagcttcaggagatagagaaccaaacaagtacctgatacccttgtggttccctcatagtattacgaagtcaattggacacagttggaagcgacgtgatagtctgcactatttctgcctgcactgcactgtttccagtggccacttatcttttgaccaactgaagtgcttacatcattcaagtgatatcattaaggtgtatcaacaaggcgtttatatcaaaacattacttgaacacttgcttttctcattcaagccttctgtaaaactatgaaattaattctcacgagcttgaaaaacaaagttaaatgctactacagaccagttcctaaatttagtattttgttgtccttaattgagttgtaactttgtaattattcttattgtatctcctaaatttcttagccagaagcgttgattaggaaccctcttgtaaaatccgtactctctgagtttatgttgtgactagctttagtcataagttaaagtctgtgtaactagagagtgacaaagtggcttgtggtaagagtatcacaagttagttgagttgaattctttgtaatggagtcattacaaagtggcttgtaataggtgtttacaagttagtgaagttgaaagcctacatgtgtaggtcatggtttttgtccttttgagttgggatttttccatgtaaaaatcccgtgtcttatttacttactgttttatcagcattctcagtacaacctcatagaggaccaggcactctactgtttggtggactcatacaaattaacggcatgagactaagctctgtctcaattcctcataaggctaagacctgcctttccatttgcataaggctaagcactaccttcttatgagactaagcattgtctccatctgcatatgtgtggctctattctaaaccttgcattgtcctcttctctcggggctaatatcttctcccaaaacaagactaagctctgtcttgttttatctcaagcaccatgtctctgcatctcatgggctgatatatagccaatttttccaaaggcgtcatagtccgaaggcgtcatcctcatagcctaaagacatcatgtcattgcctgaggatctctcgatattgcacatcattatttaaagtcgttatggttcagaggcaccattctcatgttctgagaacatcattccatggcctgcgaatcccttatctcatgattcatggcccgggatgtcatggtctaaggacatcatcctcaccgtccaaagataacattcaaggtccaaagggaatttgcatcatgtttaaattctcgcaataatccatatatattgcacgcatcgtgttttaagttttgcaggtaatccaggaagtaactgttcttcaaacatgagcaatcttcgctctagtttctattacaacgttcacatttcacaaatattttaaacataaccaaccaccatcaattcccgcttcttactctatggctattcatatacttgctctataacatatctgttacgtttcatattcacattcataactctgcataaatccatctaatactatccttcccaaaagaaccatttccgaaacacacgactattcatataataattccatcagtttcattcaccgttgggtccagaactatacacggcctgattcctgtaaaatcagggatatgtaagcagctcagaaatcatattgcggcctatattttttcaaatcactccattcggtcaaaattggtcatcatttctttactcgacaactctttcatccctcccgggtaaagaggggcagttgttgatacccactttttccctcctatatttcaaacatgcatatatactttcaaaatagtgcatgagcattatcaagtatttttcctaatttttaaagattttttaatcaatttattcccatattttattgtataaataatcattaattgcatcacaaatcatttttatgatgattttatcatctaacttcacttaagccttcaatagttttgatgtatttattataattatattttgcatctttaggttaaaattgtatattttgtaataatagcccttatatacttatgattacttcatttatgcaaaaatgactttttatgcttttgtagaaataaatagttgttattaatcatttttatgtacaaataatatttttgctattttatttatcattttttacaaattcttttattaattaaattgggtatttaactaatagcccctaaattcactaatttcggacctaaagtaccaaccccttagaccatttacctaaaatacctacccaaattcttggcccaacacttaagcctaatctataaccccctaacccagtccaaaaccgacccaaccctttttaaatcacagccgttgatttaaatctctgagatcaacggctcatatcactcccttccttttaattaacctacttatcccaaaccctaaccctcattatcctagccactccatctctatactctctcgaaccttcacctccttctgtcaaaccctagtgtcgccacccccaaatctcttatattccggctcaaacatggaatcaatccatgatttacttacctattttgtgttactctattattatacgctcgtctatggtattacttagattcttgccctgtttttggcaagaactacctcaataacgggtagattcaccctgattctgtgaagatctggacgatctttcgtccatatacatgttttattgaacgattcttgcatctctagtccgattcaaagcatcagtctcaactagggtttgagatctttccttgttctttactgatttttgattaatactctttcctttctcgtatttgactaatattttccttatttctgtttaatctaccgtgtttcctttatttttaccttattttgctctaaatttgattgttaatcgattcttatatgatattttccttattctctgttgtatccccttattttaagtgttactcgcatgattacatgccattattctctgttaatatactaaactctttgtttatgtattatttgccctaaaaaattagatcctaattaattttatatttaatatttaccgtgtttcatatttatactatactaatatataaacccctcccctttcccttttaagacagatgaaaatcaatatactctcactgataaacttaagatttggctatgtgctctctttgctatctcgttctatctctggtatggccagctgaaatccaaggccaaacattctgggttctcgactattgtggtgttattcttgcttttcttgtctaactggtgagtgactatcctttgtcatttcattcttgtgtatgcatgaactgtgtttatgatccagcatgtttaaagttaccttttgagcatgattctactaaattcatgtttatatgagtctccttactcctctaattgatactgttagttctgagattagttatctttgaataatatgaattctcttagaggttagcttaatgtcttttaacttgtttcatgtatgttgttttgctagttctgaaattgtcctgaacctagcatctttaggatcatactagtatgttcatcagttaatcaatactgagtctttacaaacttgtattaaacctttctctgtcattcatatgccctgataacttgccttctaatatggtatgcatctgtttggattcatgtgattatctgactatttaccttaatgcattgtctaaatgtttctgtgattgaacaaattgtcctaaatgctagtatgtacatttatgcctaattagaccttttaggctttaacttatcaagtattatgcatctgtgcataaacaactttgcaaatcttgccaatttgtcttcttaatacaattctgcctatatattctgtgttttaaactatgttatgatggctttttcctaaaatcaaatctgttttaaaatctgtcatttaccattgtctccttttatatgctgctacttgtaaactcctattcttaggtcctttaggttctatctctcacctcctcagtgtgagcactgcttggggtccatgtgagacccttgtgaactctaacacactagggtttggtttctaatctcctttgaactgtttttgagtatttgttctttagtgtgagcattgcactgggttcttgaaacccttggaaactttgacacactagagatttaagttctatgtgctatgggtgaatcattcaccactgatcattgtatacttgtgaaagtgagccttgggtctgctatggtttgaaggcctgaattgcccgggtgtattttggcatgctgtaggctctctatagttttacttaccttttgtaattcgtttattaactctggtttgtaataattattgtaataataattatggggtatttatttaattgggaagggtttcttatttttatttgcaaagtcgagtagaaatcctgcctatagggtctctatttgtgctgttaattctgcttataagtttcgtattatgttgttgtatgttagaaatcctgcctataggatctatgttgtgtttacatgttagaaatcctgcctaaaggactgacattatgatttgatgaaaatcatgtatttaggtgtatcaatctgtccaataaacgtgtgttagcaatcatgcccataggatcaatgtttgtcttaattgtcttctggctcagtgtgtataaattcatgctcatatactgctcaattctagaaaccatgtctataggattaaaattagtttaatgctataaatcatgtatataggattaaaaccaattcaaacccagaaatcatgcctataggataaccatcatcacactcgtataagtcatgcatataggattctattaactgattcggaattcgattatcactgttaaccacttagacaatatgcctataggatttaacaataattctggacttgtgatttactgttgagatgcccagatattgtactgaattaaaatcaataggcaaatatacgtaggccctaacactcgcatgaagaaatgtctctgcatactactgctcgcttgttcatcacatagatatcctgcctataggactctaagattaataaagcctgctaaatcagttgcgtgcatttgttgtttacatgcggaggttaacgtgagcccatacatgtctttatttgaaagtcctaattgttttgtttgtcgcttagtattttacaattttgagaaccttatgcctagtctagaactttcctaaatagaggtcccaatgcctccatgaccttaggtaagggacgggtagtgcacgcataggacatgagttagaatcaactcaagcgctttaggtaaaactcaaagatagtaatccggtagcaggagatgatagtttgtgaccgctggataatatgagtaacacccccgtcttgggggagttacgaagtattatttatgttgcgtgggatgatcctataggctaaaaactttaggacccccatccttattaatagtttattcgcttcttcagactaattcgcataatttaagttcggccgagacccaccgttgtggacctcgaggggtgcctaacaacttcctcttaaggtaatttgagcccttacccgatttctggtgatgcaagctggtataatctgagttatttgttataggtgccctaacgcaccttaattcgttaggtggcgactataacaaccaattcctttttgctactttctcaaaaggagttgtcaaaatgtctaaacccgatttcgcgagaaaagggggggcgcgacaatatacaaaaccattgaaaagaaaaaaaattcaagatctcttaattttagcatgtcagttacacgacacccacccacccgccatttccaataactccccctacatttaagattttgtttcttttttctctctttcgtaataatcacccaaaatgtctcttttatttttataacctccccccccccccccccaaattttcaattcttttccttttccacggtttttcaaacccaatttctctttttttttactaattactaagatctctatttcttattgagacaatgcagacgaaattcgaaatattgctctagaattaagttgtgggtaagttttaaatcttgttttctttctttctaaaatttttattatatgtgacttgtatatgatacatcaatacccaaaatagtactcgatataatactaatacaattatattaaatatttagggtagagttgtgattgaaacttgaaaaagatgaagatcaaaagtgtatcataatttttcagaatgtatcgtgattgtattataattgtatatgtatcataattgttgcaggaattgtactacaaatgtatgataattgtatatttattgtatattcttacgagagttgtgagttcgtgacgaatttcatagtttgtatcacaagtatgataattgtatattaatttattagtattgtatcatgtattattttgggtattaatgtaccagatacttagatacaattatgatacaagtataatacaattatgttttaggtattgatgtatctgatacaattcaaatacaattatgatacaattatcatacaattatgacacaatttgtaaatattttttaataatataaagttgttggcaatggtaggaagagagaagatgaagatcctcgacgtagattaaggtattttgatatataaaaaaaggagagagaagaggagaagggaaaaaaagaggaaatgatgtaactgaatcccttaattaaaggcactaataatggggtgggagccttttaaggagcaatgtatacaatttatacaaaaaatctagatacttattaaaaactacaaaatatagagaatataagtaaataagtttctaatatagtatagctaggtaaaaatcacaatggacaatatcgtccctgttattggtaaaaattacacggggcgccctatttggtcgcccccatttaatctatatccatatatttaaaattctttaacttataccataattttgacaacttcagatgccttctcttcttcctcgtgacctatgcactcttttcttcctcatcttcttttctctctcaaacacatttacatggaacataagcattctaaagatgatttctcttagtacagcaaaatgcatttctaatggcgcccatgaagctaaagcttgttcaagttcaattcgaatctatttttgcttttatatttccttgtctaaatgtctgcaaatcactgaggctattcgagcagagtggaagatggatcaaagcactgttagaagaagctgaaaatgagaggatgcatctcatgactttcatgtaagtagccaagcctaattggtacgtccctgctattgccattgaaaatctatactgagttcctcaaggaattggacaagggtaatattgagaacgtccctactcctgctattgccattgattacaaggcttaagttatattttaaagccatctaattttaaagaaagacagaacagaacttcaactctaagaatactgaagttcaacaaatataaacaaaaacttcagctactagaatgttgaagttcagcaaatataaacaaaaattccagctcatagaatactgaagttcaacaaatacaaaacaaaacttcagctcctagaatgctaaagttcaacaattacaaaacaaaaacttcagccaaaatatgttgtagttttattgaactgaagtttgtcattgcactatgaactgaagtttgtgtgattgcctttgcaagtcaggccaaacttcaggcaaaaatatctgaagttttgctttgatgaggctacacttcaggcaaaaaaattatgaagttcaaacttcagacataaatttttgctacttcaggcccgtatatttgaaattacccgaaaaagtacgtacccttgtaattttttatgcaaaacgggtataagttaaaaggtgacccaaaaactcgatatatatcccctgttattgggcgtttatctcttactcactagtggaatgggctaatgaattgagaattgagcctatggcaatttggtcactgggtttccattcttacaagagaaatactcttgggcttctaaaaggaaactcaggattaatgggttacttaaccgggccgagtttggagcaagactaagctgttcgggtatctggcatttgacaaagctgacgtggcactatctatcagtacatctcctaaaatctcaacgaggcaatttaatttagagaacataaggttaagcacactatattatgatttaatatcggatgcaataaattaaacactcataccccttatattatagaaatcctacacttaaacccctataaggtatatctatagctaaatatattaatttttttaattaaaattagttttaaacaaacgaaagtctattttttagtttgttaatctatccttcggcgtcaaaattgtcttaaaattacttaattcgatgaagtttatttgttgtaggatttcaattctataataagtttaaatattttaaaatagggataccattatatttaagtgttttgagagttctttgatttttttttttgccaaatagtaaaagttagggacagacacgtataaattctaatccatattcatccaacaccaagtattccaagattcattcaatgtaactataattatagtatgttgcaaacaggtcggcgaaacctaattcataagtttcaaatcttaactccaacgtaattctccacgcttatgattatgtggcttcgccgccaatggtctatataacattttattcactataaaaattaaatttttttcgaaaccgattattgtattatgttataatataatgtgtcaataacatcacttcaacgtaacagctaaaaaatatcaaaacaaacaagactgttatattcgtgactgtactctctacaagtaatattggtgcacatagtaggtgaatttcccccatttaaggtgatcttttttattcgataagaaacattcatgtatatgtgctagactagacataacaatatcgatatgacaagagcaacaacacacttgccaatatgtgacaaaagttatctcacgccagtttcttagtatcaatttatcttcttgtctccacgtgatcaagttgaactagaaacacaactcctgtgatatctagaaacgcaaggctatgctattatatattggtcaataaatttctcaccgccagataatccaataaacagcaccaccaccttacacttttgcttgcagctgttttgtaaatctgctggttttccagtttgtgaaaaagtatatcgaaagcaagcaacaaataacaatacactattctttctgacttacgtactaaaggatattgaaatttatgacatccaaaaccatggatgtatctagctattgatctgtagccagcattggcgatgactttcaaatctttcgtaagcataggatttacgcatataacgtaaaatcgtaaatcaaagcttactaactactaagtatctctttttccatttttgccggaacacatttctttttcaacttttcttattagagaacctgcaaaccttctttgttttgtttaatcatttagtattcaggattcattaggctggctaatttagattcgagccaaaacctttgaacctaaaaataagagaaatcaaaatggtaggttcttcctttatttttttttcaaaaatttaattaacttccgtacaccaaataacatgataaatcattgttacaatatctagtaatttagagataattacatgtaattattcataataattaagtagagctatatatatacctagaaaaagatgcagttacttgttacaccaagctaaattataatgatagtataaaaattatatatatatatatatatatatatatatatatatatatatatatatatatatatatatatatatatatattgattcttttcattttcctccgcgtgtgtgtgttttttgttttcttttttggtggggcacgggcgtgtggctggattactggggcatgttgttcgtttttaaaaatactgtgggcaaaggacaaaccaaagagctccatcagagtataatataaattgatcttgatatataagacagcttagaggcatttgctaataaggtggtggagaaaatggtgagaaaaatgaaaatgaaaatgaaaatatatagtccacaacatttagcaacatcatcgtatcgattactttggtaactctaatcaagaatgaatgcaagagatgcagtggctttacaacagttgtgtactccatattatgcatggtatgcttgcatggaattaacatgattttcgtaacttttttggattcattacattacaacttcccaacagtattcttttcttccttcttatctttgactctttccttttcctctgaggttgtagacttgtagtatatgtgaatgccttcgaattagatataaactagtacattcttatttcatgtttttataagccggtcatttttggagacattaatattatatcattggatctgacactacaaaaaattagaattagttacgaacttcgtcgctaaattattcgttcttaatagaatttcttgataatttatcaataattcattgttaaatcggattagcaacggatttttttgtctagctacagaatttatgatccgtcgctaatttttactttttttagtgtaaaatctgcagccaaagcttaagcagagcatgcataggcagttttgtatgttaaaacttggcatgaaaagctaatcttatactatagtttttgagttttcaagtataattttggaaccattctgtcatttaggttaatacaattatcatgtataaactcgtaagatatacaatattttcttggatgtaatttctttgtatagtttctatcaattttactattaagtttctttgagtacttttgctattctttttatgtatattcctttctttgtgatttatgattttcttgataatccataattaagcgcatgtttattcttttacattgataaatgcaattcttttccaaatacatagctttaatcatgactttctaatttctatttatgtgtttgagttgtttgttgttaggtcgaagcaattcttagaaagtgaattcaatatttaactttttccatcacatgaaattttgtaatgcctctcttggtttcttgatttaataattttgaaataaacagattcttaatactagatgatacttttttttagatggttgtcttgctttaggaagatactgatcttgctttaacaagaattttttttcttttatgcgggaaataagattgaactcatgagttattttacatctttaaaatttttagtaagtaaataaatcaaagagcgtataaaaccaaaaatacaaaatgtgaatatcttgggaaagtcaccgaccccctcgactagggggttggttagccaatgggagggtagaaaaagattttttcaattaaaaacatagaatactgctttctccaaaacaatttactttgtgcctcacacaacttgtactagttgtgtgagacctcttttttcgtctcataattttgtggacccaaaattataaaatataggttcacaaatttgtaagataaaaagagatttcacacaaatagtgtgagacctctttttttgtctcataattttgtggacccaaaattataaaatataggttcacaaatttgtaagataaaaagaggtttcacacaactaatatcagttgcgtaaggcaaaccataaaacttttctccataattggaagataattttgaaagcccttattttatacttagctatgcatataatttcaattttttcttttaaggttaataaacttataattgtaattttattattgggatattagcacttttagcccctgatgaattgataaattattattttagtcctcatgatatttggttaagcgcattagccttcaattacttaaaatgtacacttatattctgtatttgagaataataatagagatttataaataatctaaaatatgacgtacttcctttgtaaaggaaaccaagatacacttcttgatttattaaagattaagtatgcttattgaaatatcattgtataggcaaaaaaattatcctagttatatttgggccacatcagactaaaggagccttcgaaggctgcctatgtcatcagtatgatttcaacgaaagatagatttaaggtcgaaatgatctgacgaaagataagggctaggtcgaggagtcaacagaggtcgaggttgaggacgagtaccctccttaatggagcagtaacgactagttttggggatctgactttaaagagaatattcctaaaatctgtactattagagttttgtggcacatgtcctcttataaataggaagagacatagttatagagggcattggacactcatttgtaaaagaacaatactttgacattctctaaagattcttgttttattatatacatataaaagacaccttttcttgagattctgatataacttttctcccacgatccaagaaaaattcgaatattcaaaggcacatcaatcatttatcatcgtcatagggaataccacacgatttcatccctttcgggcatctctcttgcatttatttacaataattccattatataccattattgctatttaatgctattcactttgtatttgagccattaaatattgtttattgttacatattcactgctgttcctacttctatatgacattttgtcatggtactagttaaataatcttttggatattaatattggctaaaattaaccttatttcattaaaaaatcgtattgtttaaacctagatctaaattttgggtcaaacaatcataaaaatcaaaatcagaagttatcaataattgagagctcaagagtgcaatatccatttattctatatgatttatactgtacttggtaaagaaccaataaattgtatctttagagctaattcttttttaattagctaatgaaatgaatcataaatacaatttttggtgttttctactctgtcacaggagtcatttggttatgaattatgaaagcataagaagattttggatcaagtgccaaaatgtcgaccgtttccaacactctagaagaagagcttgtgcacaaatctatggagttcatatattgctataaaaaggatgcagaagctatgattttacgtttgtggataataactaataagagcaaaaatatcctcaaatttttgtgaaagatattttctaaatgttgaaacttgaaacgtattaacaagagatggttgctaagtatgataagcaccctttacctctaattttaaaagattgtgggttcagatcaccaaccgagtaaaattaaaagctcatgggaaagggtaaagaaaaacttgaaggaaagggatgcagtgggttttttctaatatggaacaaggaaaaataacattatacaaccgctctcaaaataatagtcgaaaaatatataatttttttgtatatacatacatttgtatgatatatataaaattttacaatttttatatactttttcagctatcgaatataaatagtttctacctcgagttaaaaattgaaaaaagccctgaaaaaaaaaagctagtataaaattgtgggccgcaagatagagacacgtgtcaaactactcgaccaaagtgaaaacttttactttagacccgcgtcgcatggaattaatccacctgttctcccattttacgaagccccttcggttgagaatcagaaaaaaaagatagtagaaagaaggcgccaatggagaagatcagagatgtaaaacgacagagagaagtaactcgctaatttattaaatcaatttttcactttgcttcgtaagtgttttttcccgcgcttttcccccttagaatcagttgaaattttctctattttttcctctaattaaatctacactaatgatacttagattactgtatatctggaattttaattgttgctattcatatagaatgagattacatggaaatcaaacaaaaaatcactgttcataattgaaatggagcaattcaactgcaaattcaagctcctagtggtttaattactaagttaataatatgatcggtgagcatacacttgtaaaattaggtttaacaatgttaacttgcatcataagctaagttctgaactatgggatcaatacctaagaaattagaaattaaatcaacgaggaagaagactacttaatttactcacttatgattaatacgcttctgaatatgtgatggtttagctttctagagttatcccgttattctctttgcaaaatcggtaacacgatagttgagattatactatgatgttcacaaaattatccaggggggcatctgattgtcccaaaatggagggaaatcagatttttctctgtacctttctgaatagataaacagaaaatatgccattttctaaaccaatttgtcagagagatagagggagatatatatatatacacacacacatatatatatatagagagagagatgaacttttcatctcgatgtatggccttactatcctggatttatggttcttttatctgatagattgaagaaaatattgttgtcaagtactatttagcacttttacttagtttctaaggagataacctttcactttatttagtacatgaagtatcagcttgaattaggactaatgatgactaaattgtttgaaggggagccttggagcaacagtaaagttgtctccatgtgacctataatataggtcactagttcgagccgtggatctactaatgcttgcattagattaggctgtctattggggatgcggcccttctccggaccctgcgtgaatgcgggatgccttgtgcaccaagctgccctttgcaccaagctgcccttctcttttttgatgattaaatcgtttatgccatttggtgttctaaggaattattcgtaagtaaaaccaaaagaattaagataaagaaattgcaggcatatagagtagcattaacgatggattctgatattttccttttatgatgtgaaaatatagcgactaatcaacttgattagcaaaggtgatatcatttattccgttaagtgcagtaaggaactatttatacgtaaaaagaagcgatttggtttaagaaactgtagatgtatttgtcataatgtcaattagttgaaaggagttttgaaatgataagtagattgtgatatacagcttggacctatgaaatttagtgagatcacgctgataaacagttttatatggttaaagactcgtcaattgacatgccagacttatggaacttgatcttgaagtcacacttccttcttagcttacaagggaataaaaagaaattaagaaagagataattttactaaagttgctattatgctggctaatttgtgggtttcatttgcagaacaactattgttgaaaggtgatggtagctgtatatggttgcgatggtaaatcacgctaatattctttgcaggtgtagttagtgtaagatcttaactaattctccttgtcaatttactctcaagatctaccttgtttgggagtttgtgctttcaacaagcacatgtaccagagatcaatgtggcttgattgctgaaatgttgttgctctacattagcctcaaactggataccaatacaactttaatgtcttaaatgtggtgaatgtatacaaaatttctgcaaattgaaatataatttttttgtttccagtttgtaacatctatctgctgaagtttgtggtgttagccaaccgaggtaaagcatatgcgcaatgaagatcctgatggtgcatttgtactttgttaacaaattatgggttctcaaatcatacatgacctctatgagaatcctacttaaaaataaatagactggtaaactttgtcccataatttatttgtcacagtgaggtctcttacatgaagattgaagagcccctcaccattgatattagattgactcataagaaaaataggtactgataatttgattgtgcatttaaacaagtacaaacacacaggttggcagcatggagtttgagtgtgaagaagagatttcacatatgctctctcagggaccataaccatcatgagtttatttttagtttgtctatgtactttccttcgatgatatttttttgagaaatgaagtcaaggaaatcactgaagcttccttctttgtaggacaagatatgttgttcgttgacaaggtctggtgcaggtctaactgttttacctaaagctagactatgaaggctggcaattgaaatgcgctttttttctgagttaactgctgctcggtggagaacacttttgtatctgccattgctcaatacttccatgtgatctcccagctgaacaacgagagctccttcaatgactggaactgcatgccacttttcatctcggtccatgatttgtaagccctggtaattttgaagaatgatggatagcataccataatctgtgtgtggtggcaatcctagtgtaagatctggctcaggacatgctggatagcaattaacggccatgacctgagagccttctgcaatgtcttcatgtaagtaactagggtttagtcctaagctctcaaatatcacttccatgagttcttcttgcaacttttgtgctgcctttgtgtaatttcccattttctccctgcatgataaactgctttaggcacttgaaaaaattatattgttcttgaacagtaagaatatgcatctataagacagcaaaagcatattgcaaggaaaatgagagacttacttgtaacatgtgggatttgatggccacaagtcaatccaagttgagattggattagcgtagtgcttgaggaagtctctccaaaagtgtactttgtctttgacatgatttagactagtaccatatcttatgggttcatgaacatttgaagacaagagatgctttttctcttcagttggtaaatcgaagaattcgcttgcagcatctatggcatctttcatgactgacagtgggattccatggttaactacctgcaaagtcatttatcacatgcatgttgttattttacgttcaggttgaaagtattttcttcctgttagacaacctaagtagctgaattcttggacatttgttttaacaaatttgaaaataaagggaagagagaagacagaggagatgaagcctagaaccctaccctgtgtgtgacatgaagttatttctgcttcttgatttccaaatgctttttctatatgcggatgatctgacatcattttacttggtgtgtgcataatattcaatggatcctatcttgaggaactttatgtatactgaagtaaataaataggcaagacaatcttattctagtgcgtgattgcaggtgacatggatgtaacacgacaagtagggtacctggaagaaacctagttccttgcaagccaggtgtacttcctggattatctgaggccgaagaagagggtgtcgcagaaaggagagatctacaacgggcaagcatgtgtcacacagggtacgctcggggcgtaaggatgggggaagaatgtaacgcttgggaacataggttagcccctcttcatttagtgtcatggcagtagtaaaggaaccatttggtgaagctgagctatctctcatttttcccaccatattgtgctctttctccctttatgttatggcttatctccctatttataagcaacaaatgtgaagataagattggagtttttgattatttttccagttatatatgtaatgaatatacgtataatgtgacggtaccatgagtataaccaatggagaaatagagaatactcatacatgaagagccacaaaatgaaacattataagcttgtagtaactccaatgtgaaggtaattgtcggttccaatagttgaatccgatagagtaacagtgttcagattcaagtgggagtgagcccacgcgccatgagggagaatggtgagctaattttacacatgcagtacgtaggcgctctgggattttcgaacgttatatttcctgttttcctcttagtatcctatcaggtgcatttttcctacccatgggggtgacgagaacagagtaatttactgaggcggcaagcctcatgtttcttatttcttttttttttcttcaatcgaaaactcaaatgaaataagaaattgacatgtgtctggtttggttgggtttgatttttatttttttaaaattttggacttgattttagtttgaataagaaaaatttcagtgtgctgtattttaaatatatcttttctcatagacaatccacaaatactatgtgattttttcgttaaaattttactccgtatatattcatgatccttacttgtaatgtaatctttaatatgattattctgatgaatgatccattttgcttatttaaatacttaatccaatgaatgacactttttttattgagagttatttaaatccttcgatctactttttctttcattttcacaattcaacatttattaagctcatatatattttttactttgatatattgtatgttgacggttcttaaaattaaacttagcatattattatttaggtttcatattgagtttcatgtcctatattgagaatttttaggctttggcaggaattgcagagaaaattcctcacataataataatttaataggtataagtttgtccatttgtttaattcttgccaagaatatattgactaatagagttgtttatccattatttctacttatattaatcgaagctcctcttcgtcgtcgtgtatgattgctgaaataagaaagtaacttgagggtagttttgttattcgttcagctaatttgacacttaattctgatatggacgcaacgtggccttcatgtactattgagcaatttcattggctaaagttaaagctttttagtaaaagctttatctgcttgacgattttaccctttactatttcagaagccacaacccaaggatatcttgcgttttgtaatgtgggaccaaggatattggttcaaaaagaagtttactgtttaaaagtttaaaacacaataattatattggcgtatacggttaaaatcgggtttgtcctttcttgtatgactaatggagactgcaacgtggcagaccaaggttcgaccccatgttatatcggaccgtgatgtaaagtagattgcagagcttgtgactcagagatcgatcgagatcgaaatcggccaagaccgagaccaagcaggatagagatcaagcaagatcgagggaagcttaccgagccaaataaccgaaagccaaaatatccgcaatcagatgaggatcaccgcggaaatctcggcatgtatcaagaagaggctaattaattagctaatcatgggatttcttattgtatttagaattgtattaaggtaggactcccctactatataaagaggacatgatcatttgtaaaaggcatcatatttacgcaatgcaaagcaatatactacctttctcttaaactctcaatactctgttactttgttcatatttccggtggaatattcgtttggttcgagggcaacctagctcgagggccaaagttatacattttctttggtttgcttttatttctatttatggtcaatttcaatagcaatttacgtattttctcaatttgtaccaagtaaaatcacgtgtccttaaaaccacatataagttcaactgttatccgttttctagggtaagcagtttggcgcccaccatggggctaagaataatagtgattgtctggtactaactttcgtgacacacactattttatacttattcttgtgagtatctttgattccaggatcagcatgtcaaactctcaagcaacacccacacacatagacaatggccttggtttccatgacggaaacaacaacatagccaccctagggaatgaagtacctccagctgacctcgatggagtcccgtccgtagacccaatcgacgtcagctctcatgttaccattaatgcaaatttggtcgtcgatcctgagagtagcgtccgcagagacgtacgatcatccggtcagaacgcacagggcggtgaagaaggcgggatcagccttcgagtgatattcaaaatatcgcaggcttaacaagttgcaatagcactactccaaaaccagaaccatgcatcgagcaggatcgagcccgagccattataggaagttgttcgtagggccgaatcagtgtcaaagagatcgaacggaaatgaatcagggaccgatcccacaatcatgaatatgctcgaggaactagcaaagccagttgaatcggggtagaagaaaattgaagcaaatgacaagaagatggaaacctataattccagggttgatcaaattccggggtcaccaccgattttgaagggtttggattcaaagaagttcgtacaaaaacctttcccccgagcgcggcccctaaactaattcccaagaagttccgcatgccagaaattcccaagtataatggaacgaccatccccaacgagcatgtcacttccacatgtacgattaaggggaataatctggaggacgatgatatcgagtctgtattgttgaagaaatttggggagaccttgtcgaagggagcgatgatatggtaccataactttccacctaactccattgattcatttgccatgcttgcagattcctttgttaaagcacacgccggagatataaaggtcgagacaaggaagtcggacctcttcaaggtaaagcagaaagataacgagatgctcagagagtttgtgtctcggttccaaatggaacgtatcgatctaccaccggtcgctgatgattgggccgttcaggccttcacccaaggactaaacgtatgaagctcggtggcttcacaacaactaaagcaaaacttgcgaatacccagttgttacctgggccaatatgcataatcgataccaatcaaagattagggtcgaagacaatcagctggcgactccttctaggtctgtttatcctattagaccagtcaataaagtcaaaagggacatcgaccgagagccacggtcgaacagggatcgctaccggccatacaatggagatcgaagaggcaacgggcctgggcgtaaccctattcgaggtgaaaggagaaatgatagaggtcagaactctcgggggatcatgagcaagaatggttttgatagggatgtcgggcccaaagaagcacgtgactatcagaatataacttcaatattgatgcatccaccatcatatcagccattggacatatcaaagatactatatggcctcgacctctacagactggtccagcccagagaaatcccaaccaaatgtgcaagtatcatggcacccatggccatagaacagaagattgcaaacagctaagagaggaagttgcccggttgttcaacgaggggaaccttcgggaattcttaagcgatcgggccaagaatcacttcaaaaataaagattcaaacaggcagaacgagagaagagccacaacacgtgattttatgaatgttggaggggtcgatattcctcaaggactagtattaaaatgcaccaaggtgtcgatcacaagggagaaacgaactcgggattacgtaccagaaggaaacttgtcttttaatgacaaggatgcagaagggattgtacaaccctataatgacgcactggtaatatctgtacttatgaataagactcaagttaaacatttcttaattgatccaggtagctcggccaacatcatttgatcgagggtcgtagaatagttcggcctataggatcaggttgtgcccgcggcccgagtgctaaatggcttcaatatggcatgtgaaaccaccaaaggcgagataactttgctagtagacgtggttgggaccgtccaagagatgaagttccatgtgatcaagggagatatgaggtataatgccctatttgggaggccgtggatccataatatgatggcagtgccctcgacccttcgccaggttctaaagtccccgacgctagagggagtcaaaatagtctatggggagaaacccacttccaaggaaatatttgccgtcaacgaagtgatatcgatattggcactctcatcaatgaagaggtcaaatttgaagggaaaacatgacgtcaaatagcaaccacaaacaccggcctcgacccaatcagagaagcagggggatgacgaggatgatgactatagggttcctcgatccttcatagtcctcaatgattccgatgccaccaagtcaatggtcgaagagctggaacaaatcatactaaccgaacatcagcccgaatgaaagatatacctgggcacggggctagcccccaagcttagggaaaacttattcaattccttaaaactaacatggattgctttgcttagtctcatctcgatatgacagggatcccaccgaaaatcaccacccataaactaagcctggacctgaagttccatccggtgaagcaaaaaagaaaaccccaatccgaggtcaaatacgctttcattaaagacaaggtaaccaaatttctcaaaatagggtctatccggaaagtaaaatatcccgaatggttagcgaatgtagtagtagtccctaagaagggaaacaagcttagaatgtgtgtagattataaagacctaaataaagcatgccccacggattcttttcctttgcctaatattgatcgcatgatcgatgccatggccagccatgagatcctcagttttctagacgcctattttgggtacaaccaaatacagatgaacccgaaagaccaggaaaagacctcgttcattactaagtatagtacctactactataatgtaacgccattcagattaaaaaaatgttggtacaacctatcaatgcctagtaaaccgaatgttcgaagaacaaatagggaaatctatggaagtttatattgatgatatgctagttaagtccctgcgagcagagaaccatttgaaacatttgcaggaactttcagtatattgaagaaatataacatgaagctcaacccagaaaaatgtgcgtttggggtcggctccggaaaatttctcatcgtcatggtatccaatcgagtaatcgagatcaaccccaacaaaatcaaatctatcgaggacatcacggtagtagacaacatgaaggtcgtgtagaggttaacagggtgcatagccgccttggggcgattcatctcgaggtcctccgataaaagctatcgattcttttctttgttgaagaagaagaataacttcacatagacttcggaatgccaacaggccttggaggagcttaaatggtacttatcgagcccaccgctgcttcacactccaagggcaggtgaacacctttacttgtatctggcagtatcggagatagcggtaagtggagtcttggtctgaaaagaacaaggtacacaattacctatctattatgttagttggaccttaggtgaggccgaaactatgtatccccatctagaaaaattagcgctctctttgagaagcgtctctaggaaactaaaaacatactttgaatgtcatcctatatgtgttgtaacaacttatcctcttcgaaatattttgcataagcccgagctttcgggacgattggacaaatgggtcgtagaaatcagcgggtacgatattgagtatcgatccctaacaaccatcaagtctcaaatcttggtaggcttcacgccggccctagtagttgaaagacaattattagtcaactcgggtacatcttcgggaatctggaccctctttacaaatggtgctttgaacacaaaggggaccagacttggcatcgtgctaaaaccacccacatgtaatgtggttacacaatctattaaaactgtaaaattgaataacaacgaggctgaatatgagaccataattgtaggtctcgaactagctaaaggcttgagagcgtaggtgatcgaagccaaatgtgactccctcctcgttgtgaatcaggttaacggaacctttgaagttcgggaggaacgaatgcaaagatacctggataagctacaagtaactctacaccgattcaaggaatggactttccaatatgtacctcaagatcagaatagcgaagccgatgccctcgaaaacctagggccatcggtcgaagacaacaaactcaatttgggggctgtcgtacaactcatgaggtcagtggaagaagaaggccacgtcgagataaactccacaagtttgacctgggattggagaaacaaatacatagagtatttgaagaacgaaaagcttccctcggactcaaaagaatcaagaactctacacgcaaaggcagcacgattcaccttgtccgaagatgggaccttgttcagaaggatgttcaatggtccgttatcattatgtttgggaccaagagataccgaatatgttctaagggaagtccacgagggcacttgcggaaatcattctggtgctgaaccattggtctacaaagtaattagagccggatactactggatcaacatggagaaagatgaaatagagtttgttcaaaaatgtggacatgcaccgatgattcatcaacccggggagctactccattcggtcttgtccccattgacgttcatgaattggggaatggacatcgttggacattttccatagggaccaagtaatgctcaatttattttatttatgtctgattatttctctaagtgggttgaagcacatgctttcgagaaagtcagggagaaggaattcatcgacttcagttgggatcacatcatatgtcgattcgggataccttccaaaattgtatgcgataatagaatgcaattcatcagcagcaaggtggctaaatttctcgaagattacaagatcaaaagaatcttatcaacaccttatcatcccagcgaaaatggataagccgaatcgaccaacaaaaccatcatccaaaaccttaagaagaggctaaccgacgcaaaaggaaagtggaaggaaattttgcccaaggtccttgggcataccatacaacatcaaagtctaatatcggggctaccccattctcattagtttaatgcgttgaagctctaatacctttcgaggtcgaaaaatcgagtatcaggttccgatatgcaacagaagagtcaaataacaaggctatgaatacgagcctagaattattagatgaaagatgtgaagtcgccatcattcgattggctaccctaaaaaacaaatcaggatatactacaatcaaagagccaatcttcggtatttcagcgtcggggaattggtactaaggaaaattaccatcaacatccaaaatccaaacgaaaggaattgggcccgaattgggaaagagcgtaccagattctcaaagtcacaggaaaaggatcctacaagctcggaatgatgaatggaaaacaactaccaagtaattggaacgtatcccacctgttattttgtatgagtccaccaaatagtagagtacctggtcctctacgagattctgctgagaatgctaataaactgtaagtaaatgaaaaacgggatttttatgtggaaaaatcccacacaaggggaccaaaaaccacgacctataccagtaggctttcaacttcactaacttgtaaaaatctattaaagctactttgtaatgactccattacaaagaatttaactcaactaacttgtgatactcttaccacaagccactttgtgacttcttagttacaaagacttttactaacttgtgatgctctaaccacaagcaactctgtcactctacagttacaaaggcttttgcttatgactaaacctagtcacaacataaactcaaggagtttacggattttacaagaggattcctaatcaacacttctagctaaaaaatttaggagatataataagtacaatcacaaagttacaactcaactaaggacaacacatgctaactttaggaactggtccgtagttgtattcaactttgttcttcatgctcgtgaggattgatttctttgtttttgcaaaatgcttaaataagaaactgaaacattcaagtgatgttttaatataaactcattgttggtacaccttgatcacatcacttgaaataatgcgagcactttagttggtcaagaaataagtgggcactggtgacaatgtagtgcgacagaaatagtgcaggcagtcacttcatttccagctgtgtccaattgactgtgtactgctacgagggaaccacaagggtatcaggtccttgtttagtttcctacctcctgaagctgtagcaattcacctttagctgaaatctgttaaatgcagtgtagtccaagtgagtcaggttccctatctggtccttgacattaagtttgttagatcatcaaaacacaaggaaaagatattgaaaacctatcaatttccccatttttgatgatgacaaacttagcattgataatggatttagagctaagagaaccagattaagtaacaggagaacacaagttgcccctgactttatgccctttttaccccctattttatttgttcccccatatgttccccatgactttatggtcatattatactattatttttccccttttggcatcattaaaaatacacaatcataagaaaaatacaaagaagtctagctaagctaactcatgccacatatgtgcacacaaacacgatagagaatagaaacacagaagtaaagcactgatataataaaagaggatagaatttatattgataaaactttaatatgcctttgcttaaaaacaagaggcaatatggactgttaaagagagagtagtagtgtttcatcccaaccacataaaaaaaacatctgccaaaaaaaaaaccaaaaaaactgaagaacatttccagaatttggtcactaaagggatacctagaggcactaggagtagaaggcttggaggctgcagcaagtgtttggagaacaaggtctattcgggcattgaccgacttttgctcgttgatcagttttgctttcaggttctctacttgcgccctgagacaacaaatttcctcaattgcactattttgagcattaatcagctgtgagacggttgatgtacttcctactcccccattcttttccagacactcacattcgcccaatgtagtctgtgagaaagtctgcttcttagtccccaccttaccttcccccaatggcaccgcaaagaagttaaacactctggtaagcaaaaaccgatagggaaggccatgattgccatccttgaaggtgggtaccttttgcatgtgcttaatcataatagtaggcatgcttacagggttaaaactgtccagttgctccatcaagaacatgtaaaacttagaggccacggacctcctctcagctcgaggtaataaaactttgttgaccaactcaaaaagtagctaatagatagggagtaacgccttcttatggatctggtcccccttctagtttgcgttgtactttaccacagcatttctgaaattgaactgacaaacatcatttacactggacacaccggctgtagtaactttaagaaattcaccaagcagctttacatcaaacactatatccattctattcaccaaagcacagatgtggtcggtgtcaacgggaaaaaggctagaaaagaacctttgtacctcatcctcataagccttagggccatctatttgaaataaatgcccctattgttgaaactcaaccatttcaagaatttgtcgcatgtcagccgtctcagagattgcggggtcaaatgtacgaccaacagaaccttttggtgccttaggccttctgagccaagactgactttactccttaacctcttcatagaactaggttcctgaacattttcaaacttgcgttttcgagacttctcaccacttaattttccttttcccttggatgtgactagcacatcctcatcagacatcgagaactcactcacaatctccttcaatttggagctagaaggtgaccctttttctattaaagcaggctttttctttttctgagaccgtctaactagagaaccaagttcatctagtgtttcttcttccacctctactatagggatcgcctcatcaattacgggtacactgtctttcaccaacttcctccttttcttcttactacttttcttgctcctttgaagggcagaatcgtaggccagcttgaaacctggtagtaggtcattggtttcagactcaggagtggacacaaccctccacttaactatgaacgcatcaagagacacgttatctaggtcctcctcatcattggacctcatttcaggtacttgcatttccaaaggcacggtagtgaatgcaggagcagaactgtcctgggaatgagagccctaacctgggtcctccggagaggtatcaggttcctcatgtgagggcccaatagtatctgctagtgcatacccttcaacagttacaatggtcccttcgtcccccacactttgtacctcatttttctgagagatgatctcatgcagtacaccatcagcagacaccacaaaaacggatacatcattctcttcctcaattggtacaactgccaccacgaaatcggtagcaacgatggcggaactctctatgacctcagggttttgaccttgttctccacttggtctttgactagtggtaacctcagaagatggagaggacggatcaacaattttaggggtatctgaaatagagagagacgaggaatctgggtgaggtgtgattttagcggaagggtaagagcgggtaaggaaggctcagtaggaacagaagtctccataggtttatcagtagtaggtacgactgaggtagagaggtcgaagtttgtctcggccattggaacaatgatgtgaagatgcttttgggaaattctaatggagaacttatggttagggagaatagcaaaggatttttatgaggaggggataattataaagagagaggaataggcaccggttctgaaatggcggttaggcatggagaagtgcaacgtttcagagagagatggaatgatttgaagtgaagagatgtgacagcatgatctaaaaagttgaatgacatggtagttgtattttgtatcctttttaagacgtgtattaaaggatgcacagaactactaacctttggtacaagaactagattcttgaccttttatttgaaggaataaatcctcttttatctttcatgcactgcatctacagcttatatactcatcatgcgtgtttacctgcaacggtattaaagtgagttagacatggccagagaacacttttagccagttatttcttgaaggtgattttcatagccagataaagaggaaccaggttctcaattgggctttaaaagccccaactcactctgtttctttcaaattgttccctacttaatgccttggtgaacatgtttgcaatttggtcttatgtgttgcagaacttcatacatatcagccctttatccacattgtccctcaaaaagtgatgcctcacatcaatatgctttgtccttttgtgttgaactggatttttggccatgttgagtgcactggtgttgtcacatagaaggggcacactcttagtgagtaccctaaagtcctctagctgcttcttgatccataaaagttgagcacaacaggatgttgtggctacatattctacttcagttattgaaagagccactgaattttgtttccttgtgccccaaaagataagacatgaacctaagaagtgagccattccaaaagtgttttttctgttgacaagataacctacatagtctgcatcagcataagcagtgagattaaagctgtcacctgagggataatacagaaccaggtcctgtgtttctttgagatatcttagtattcttttggcagccttcaaatgagattccttgggatttgattgaaactttgcacatagccccacactaaagacaatatcaggtctgctggctgtgagatggaggagcgacccaatgatgcctccatacatggtttgattcacaggagacccagtttcatccatgtccagatgagtagccgtagcaatgggagtgtctatcacttttgatgtttccatgtcaaacctcttcaagagctccttgatgtatttttgctgacagatggatataccttttggggactattttacttgaagacccaagaagaagttcagttctcccatcatgctcatttcaaattcacttcccatgagttttgcaaattcttcacatagagaatcagttgttggcccaaagatgatatcatcgacatagacctgaacaatgagcaggttcctcccccatttctttaagaacagagtgttgtcaattttccctctcttaaagccattttccaagagaaactttgacagcctttcataccaagcccgaggagcctgcttcagcccgtacaatgctttgtccagtttaaacacatattcagggtgttcatgacattcaaatcctggaagttgcttcacatagacttattccttaagatgtccattcaaaaacacttttgacatctatttggaacaaggtgaattccatatgagatgaaaaagtgattaaaattctaatagcttccatgtgagcgaccggagcaaacgttttatcatagtcaatcccttcctcctaattgtagccttgaaccactaacttggccttgttccttgtggtaatttcatgttcaccaagcttgtttctgaatgcccacctggttcttataatggttcgatttgagggtctgggtaccaggtgccaaacattattcctttcaaactaatgtaactcgtcttgcatggttgtaatccaatctacatctttcaaggtttccttgatattcttgggttctatctaggagagaaaagctgagaaggcaagtgaatttctggctcttgacctggtttgtactccggaatctaaaggagtaataatgttgtccatcagatgagagctttggtgtctccagttagaagtctgaggttcattttgagaggatgtgggtgcgtttgtctggttttcttgcgttcttctctcaggtgctaatagagttccctgaactgcatcaaccactctttctttagcttcagtggttgtaattgaagtacttggttccattggagatgagagagtattgtcttcactcagctattttacttgactcatcatatctgcctttccatttgtcgtgtcaatgacttcacatgaactagaaagggttcttcatcttgatcttcttgagcactcttctcacaggatggataaaactcatcaaaaataacatgaacactttcctcaacacattgagtctgcttattatatatcttgtaagccttgctttgagaagagtagcccaaaaatattctttcatcactcttggcattgaatttaccaagctggtcctttccattgtttagaacatagaatttgcacccaaatgttcttaggtgagtcagcttgggctttcttccattcaacaattcatagggggttttgttcagaagtgatctgatcatgcacctgttcaccaagtagcaggtagtgttgacagcttcagcctagaagttctttgcaattccactgtcgattagcattgttctttccatctcttccagagttctgttcttcctttctactactctattttgctgcggagttttgggagctgagaagttgtgagtgataccattttcattgtagaactcatcaaatttgacattgtcaaattctgtcccatgatctgatctaatgcatgtgactctcgactccatcttcacctagattttcttcgcaaaagccacaaacacttcaacggtttcatctttagttctaagaaacaaagtctatgtgaatttggagtagtcatccactatcacaaaaatgtatctttttcctcctctgctttgcactctcataggaccacatagatccatatgcagaagctctagtggctttgaggtgctcacatccctcataaacttaaaggatgacttcacatgttttcctctagcataggcatcacagaccttttgcaccttgaattttgagataggcagactatggaccaggtccttctgaattagtttgttcagaagagaacttgtgtggctcagtcttctgtgccatagttcagcatcatcatcaacaacttttagacaactcagatcaccactttgtaaggactcgaaatcaacaacatagatgttcttgtatcttttggccacaagtaccactttaccagttaccagatcagtgactgtacatattttggacaagaattccactttgtttcctttatcacagatttgggagacactcaggagactgtacttaaggccattaacatagtacacattttcaatagaatgagtaagtgacttcccgacttttccaactccaagaatgtacccctttttcccattgccaaaggatacactccctccttgaagggcttttagtgaaagaaagtccatggtgttcccagtcatgtgctttgaacacccactatccatgaaccattgttgaccacttcctttcactgttctctgcataaggagattaagagttagttttaggaacctaagtaagtttgggtccattgtagtaggcaagaggataaataagagctctcttagtccatgcaggtaatgtgcgttatttgtgagtggaacctggtccctccttagtagtcatcttttcagcaaacacattatttttctgaacagattgatccctggcccgtcaattttctttgaagtgcccattgttcccacattgggtacaaggccagttattagagatagtgacgtacttgctatgagggttgtaagggattttctccctttggaaccctattctctgcctgtttctaccattattagtgtgcatggcagtgttggcttctgaggaccaggtccactttaagaacttttcaagatcattttttactctttccagatcagtttggaggttcttgtttttttcaattttagcacatatcctagttctcgcaactttaaactcagtttcaagcctaatgtattccacactagctatctctattcgtttttcaaaattttcaggttttgatttagtccctggtctctctattgattcccttaggtatgcaattactgtcatgaaatcacttctttctttttttgagttcttcaatggtttccttatggtcaataattacagccactaagtcatttcgagtttgttcagcttctcctagttctacagtcaaggaatccctatcctctacaagactatgataggcatcaatcaatacactagctaaagacatgagtttcttaggagagtaggatttcagatttctctgaacatccctaaaatttacctccttgttatcatcgtcttcatcatcatctgattgggccagcaaagcaaaggttgtgtcatatccattttactcacctttagctgccatcatggaactatcaccagcatcagtttcatcttcagactcactagaggaatgtccccatgttgcaagatcatgtttcatcacattgtcagcagatctttttcttttgaagtccttaaaaggaaccgggttcctcttaactgcctttttagggttgttcttggagaattcttgcttcaagagaggacagtctctaatgaagtgtccatgctttccacacttatgacatagatcatagttttttagtttactagagctacccctttttagtatttctccatttcttctgaccatcttctgaaactttttggtcaagtaagctatgtcaatgtcttcatcacttgagtcattgctatcagctttgagtaccaagttcttttctttctttggttctcttctttcactgtctatcttcttcttcatctcgtaggtcttcagatttccaataagctcttctgtggtcagtttctgcaaatcctttgatttagtaatagcattcaccttgctttcccatgggctaggcagagtactaaggattttcctcactagcttgtttctaggaatggtttcgccaagtgagtataactcatttatgatggaagtgaatcttgtgtgcatatcttgaatagattcatcgtccttcatcctgaagagttcatactcggtagtgagcatatcgatattggactgttttacttaggtagttccctcatgagctatttgcaaagcttcccatatctccttggtagtgtcgcaggcagagattctattgtattcttcaggtcctattccacatattaaaatcttcttggcacgaaaattcttctctactgcctttttgtctgcatcaatgtattctttactggtttttgccattgaaaatggatgttcttctagttcctctgttggaacataagggccatcgcatatgatatcccataactcagaatcctcagtcatgataaaatcatacattcttgttttctaccacccgtagtattgtccattgaacttaggtggtcggtatgtagattgaccttcttcaaaatttggtggagcagccataaggatccttcctaggtgttagcctgatatgagaaatctactctgacaccaattgttagtttgtatgagtccaccaaacagtagagtacctggtcctctacgagattctgctgagaatgctgataaattgtaagtaaatgaaacacaggatttttaagtgaaaaaatcccacacaaggggaccaaaaaccacaaactacaccagtaggctttcaacttcactaacttgtaaaaacctattacaagccactttgtaatgactccattacaaagaatttaactcaactaacttgtggtactcttggcacaagccactttgtgactccctagttacaaagacttttactaacttgtgattctctcaccacaaaccactttgtcactctacagttacaaaggcttttgcttatgactaaacctagtcacaacataaactcaaggagtttacgaattttacaagaggattcctaatcaacgtttctagctaagcaatttaggagatacaataagtacaatcataaagttacaactcaactaaggataacaacatgctaactttaggaactggtccgtagttgcgttcaactttgttcttcaagctcgtgaggattgatttctctgtttttgcaaaatgcttgaataagaaactgaaacattcaagtaatattttaatataaactcattattggtacaccttgatcacatcacttgaaataatgtgagcactttagttggtcaaggaatgagtgggcactggtgacaatgcagtgcggcagaaatagtgcaggcagtcacttcatttccaattgtgtccaattgactttgtactgctacgagggaaccacaagggtatcaggtccttgtttagtttcctaactcctgaaactgtagcagttcaccgttagctggaatccgttaaatgcagtgtagtccaagtgagataggttccctatctggtccttgacattaagtttgttagatcatctaaatacaaggcaaagatattgaaaacctatcatcacctaaaacagtattattgctaagctacgacccttttctatttccttttgttttagactaacacttgcaggtgatcaactagaaatagcgatggatttatcagcatgaagtctttaggtctgaaagcacgcgttgtactcttttttccctggaccggttttcccccaaatgggttttccggtgaggtttttaatgaggtaacagtggatcgcgctaacttaaaatcaaaagccaatcacaaatcggtatcaaagactgtgtttacactattgataccaaatttttccctcatatatttttaatatgcacatatattttcaaaaatagtgcacatgtatttacaaacatgcacaagtatttttatcatttttttaataattttaaaggctttcgaccaatttatttatggatttttactataaaaatatccaataattatccctcatattattttttataatgatttaatcatctaaattcatcatttatgcccaaatagtacttaaatatttttattgcatcttttataattacatttgcatttttcaagctagaattgcatattttgcaataatagcccatgcatatgcataattatattatctatatagaaaatgacttttcatatttttataatgtcaagtaattactttaaattattttcatgcacaaatgacatttatttactaattattttactgatttaattgggtatttaaaatccagtccctttctaattaatttcggacctagtccaattgtatacacctgcccaaaacccaattacccctacccaattaaactacctgactaaaaccccttaaatcaggaccgtcgatctctaagatcaatggtccataccaccatagcctcttttaacttaaccaaacccaaccctaatccctcataaccctaaagccgccgcccctgaatgctctcaatctcccctatttcactctcaaaccataagcgtcgtcaccccaaatccccaccaaatcccctttgattccaaccagatatggaatcatctggtgatttcttaccttattcggctctctttctctattggctaaccgattatggtgttacataatttcttgcctaacatggaaagtggatctctcttgttttgaaccaagtctggttcgaatctttatcgcgttctatctatgttctttctccgtctccttatggtttgaatctctggattattagcttattccttattttacctaaaagctagggtttacatcctttgaaatcatctgagatttggtacttattttcgttaaaaatcatatctatgtttccacatgactatctgtgaatcttttcatgatttcgttaaaaggttttccgcctcattttacttaccctaaaattagggcccagatcttttcagatctgccaaggttccttaattttgagtatctttcctttaatgttttcatgtatctatgtttatctatgttattcatatagttgtttatttaaaataatttattcttcctaaaattagggtttcagatcttttctagttcgattccttgtgcttttcgaataaacctcttctctatgttcgttatacacagtgtgatttttctcccttgttactctgttgactttatgatttacccaaaattagggttttgaaaccctttacgaagattttaatctttccttttttgtgcgatattaatgctttcttattttgttcgatttacgtgttcttaccttatttggaccaatgtttgattaataatttatgctacttccttttgacttaaccttagtggcctgattttatgttttggttattaaaatcgacttctaattgattctggaattattccttaccttatttgactactcattgagtccgttaactgatgtcagcttgattttatgcatgttaattgatctatgccgaccttaactgattgttaattgatttttcataccttatttgtgtgtgattggttcattaccttatgtgttctactctattgtatgctataaaacccttcattgttctgatttcaaacacgctgagacacacaaactcacacctacacttacacacttacactcacacaacttgagttctttctatcactctgatttgctgcattgtctagccggctgaaagccaaggctagactcttggattcccattgccttcacctttctgtttactttcttcctaactggtacatttttaattcctattatcttgttctattctatatgcttatgtagtcagttttatcacagaccttaacatgcttctgtttgatacacgattcctgactatctctttctcaattgttatgccttagtttttgttgtcttgttctgttccatgtgattatatgattagtttacttcaaacttcaatatgcttctgtttgccatatgtttcctgtttgcattcttcctgactagtatgccttaattcctgttaacctactctattctatgttcttgtgtagttagtttaccttggcatgtctagcccatgatttctgtttacttctttctagactagtatgctttagttcctgctaccctgtgctatgtgtttgtttggttagttatttcaaactttagcatgcttctgttcaatatacgcctatatggtcctacctagtgataattaataaactaagtaatctttaataatgtgaaaccttgatagattcagttgtatgcttcctattcagaaaggtttaggtatttccaatatatgtggtcagttatgtctgtaattcaagtattttcgtccttgttgtgattgctttaattttggtatatcatccatgtctaaactactactaatctgctaaagatggactctgttctatttgtagtcttgtaatttgaacctatttgttcataaaaaataaaatgttttttaaaactgtcccctaacccttacatatactatttttcaaacttctactcttagctatctaggttcctaccacctctagtgtgagcactgcctagggtccctgagactcctttgaactctaacatatcggagctggtttccaatctcttatgaattctgtgttgaatgtgtggatctagtgtgagcattgcccagggtccttgaggctctttgggaactttgacacactggaagcgtggcttaaggtgttgtggatccctcctactgtttcaagactgttgtgctgaaggccttgctctcaggtttatattgggcctgctaaggcttcctataatgtaatggatactgttatatagtttattcattctaggctgtaataatttctatattaaactgatttggggtttgttagtaaaagctgggggggatttattctatatctttgcttgaaattcgggtagaaatccggcctataggtttattggtgattatgtgagcattactacttgtttagagatcatgtctataggactttctgattgctttgttctgtacttcactcgcatgctagaaatcatgttcatagattccttgctttagaaatcatgtacataggatccatgcacatttttacatgcattagtaaccatgtatataggatcttatctgtttgaataataattttcctagcaacgtgtctaaagaattctgcccacacgtgattaatagatatcatacctataggaactaaaaatcaattagatatcatgcctataggaaataatggaattaatttcaaacctagaaatcatgtttataggatttaatctaatagatatcaagcctgtagggttaaatcagtttgtaaattcagaaatcctgcctatagggggcttatgttaactagaaagcatgcctataggatctaaagagatagaatctgttaaaataagtaatttgtttagaaaccatgctataggtttataattaacaattgtagataccatgcctataggattcttttattcacttaggcaaacttataaggttactaatgattctaggcctaaaaatgctaatatttactgcttgaagatgcccagattcgaggcttaataaaatcagtaggcaaaactaataggtccagattcccgccttagtaaactttgttctatattctgttgctgctcatctagatatcctgtctataggatccttaattaaagaaacctgttgatttaactgcgtgcattcgttgtctacttgtggatattaatatgagcccttattttctccttacatgatagtcatatctgaattttgtttgtcgcgtagcttttctcattttaaataatataggtcagtctagaactagccaaaataaagatcctaaatacctctaggatcataagtaagggacgggtagtgcacgcataaagtacgcattagaagctattagaacgcttaggtaacaattgaaaaatagtaatggggtagtaaaggaaattgatgacccgtgtactaactctatgtgtagcacccttacttggggaaagttaccaagtattgcatgaaaatcatcttataggctaaaaactctagaacccatgtaattcatgtttaaagtaatgtctatttgtctaaattatttaattcgcttgtgtaagttcggccgggacccaccattgtggacctcgaggggtgcctagcaccttctcgtcatgataattccaagcccttacccgatctctggtgacgtaacaggttatatgagttaattgttttaggttccctaatgcaccttaatccgttaggtggcgactcttcaaatcccttacccaatcccaaaatgaaaggagttatccctaaatttcgaaacccgatttcacgagaaaaagggggcgcgaaagcatggtgactctgctggggatatttttaggctcttaccataacgaacttgtctgcaaattagtctctaagcatgtatttattattcctaattcttgcacaccctttccccttctatgtggatttatctgcctatccttattcgtttatgattttcctcccctgctttatcacttttactatggaaactgacttgtctccttgttttcttttcttaagtgtctttaccattattaaatgctgcattttatcattattcaacatgcaaataattgacaacgtgttattttctttttgcataactccatgctcaacatcatattccactcgtgcgtgctaataccatagcggtacttaatgagtatctgcgctcttcctaaaattatcctttaaattcggaaaggcttatttgcagtaaaactagtcgatcaacggtgcagtcgatggttttgtgcctttccccctcaagttatccaattgagggtaccagtctagacttctatagaaaccttgctctgataaataactgtacgtgcatcatggtcaatcctagccggagttaatatgttgtccacataataaccctctaagaaagccttgtccaaagttcaccaggatttccttaatcacaatggatgtaatcacgatattatttggagagataaatgccaacatgctaattgttaatgtgcaagtagtcgaatccggagggggaaaaggtctaactctgtttattttgcaaaaaatgaggcacgaagtccccaggttcagcatggtgtaaagtataccaccactgttgttggactggttggaaaatctttcgccaagcgataaaaaccatgtgaaaagagttcttggaaatttaccttccttattggacattcaaccaaacaacatgttgatcgaagctgctactatgttctgggatggagaaagagttgtattccattttggtgacatagaaatgactcctctcctatagaaaatcggagggttcgctggattaccatgggatagtcccgatttactagtaccagaaaaccacaatactagggggtttctaaaaatgatgagcctgagaaagaatgaggatttggagtgcttgaagaagtcttagataccatttgacttcctctatgaatgatatgaacacagcaaatcttactgtatctttcatgatgaattctccatcactttcctaggttggactcatcgcagggtttttgtgttcatcatctactttctgagtatgatagtgttcccaagccaaggggaaagaattcccaccaggttggccatggtaaccaaagctttaattgagggaattgacggacaaacctatactattgtaccgatgattgtagcagacatataccgggctctagaccgttgcaagaaagggttcaaacactttgagggttgtaacttgctactacagatttggttgttagaacatctttagagggtatcgccaaaagtttccatggagaccatggaacgattacatcgctttccaccatcctaaaagaattacctttatcccaaatagatttgcacagccagagaacgccagagtgggcacagtctttcatcaattgaccgaggaccaggttcactggatgttcgagtggttccctaccgatgaattcatcatcagatccagggatgttctgtatttggtgctgattgggttaatgggaatacatccctatgttcctatcagggttatgagacaagctggtagaaaacaagtcataccacgagtctccaaaatgagtcactacagagccaattttcaggatgatgccattccctacaaatgtgaagctcagcataacagcatttgaagattatcgttgaaaaggataccatcgagccagatcgatatcacgccggtcatgtgtacttgtacccatcatggttagaagataacatagcaagaatatttgagccaagggttggtcaaggaaacaaggtcataaatgaagtcgctgacacataagtgaaatatgaaaggctacacaagagggtccttgaatccgaagccaagcatgtggagcaacacaagttcgacatggaataaatcaacgagtggaaaaatggctacaaggtcggcagaaaggttggagtacttagagcagggtctaatggaactggaggggaatataaggaaaagggttgtagattgttaaatgcagaaggcaacgagggaggacatctaacaagggcatacctactactgaacatgcatggcatggggaacttgattgatggagccaaaaaggccaaatatggagaaggtccttctgggacaaagtagattaggtttatctattttgagtcattttagaattcaaatgtaataaggcagatgccattagtaactcatttatttaacatcattttagattcgtcctgtttattacattactaaaatgaggcattaatcaacattaaatctctccaaatctatttgcctctaggcctacctcgggcacaacgaggttccccaaattaggatgcgaatttatgtttccgcaatacatgtttaaatcctacaagtgcttttctgaatccttactgacttgtttaccttttgtttttctttatttttattatttccatctcctaaggttagttcgcacataccggcatcattagcataccacaccagatctagaggcctccacatcctctcctccgagtaatccgaaaagcaaaggaaaagctaagatggatgatttgagtggtatccgaaaagaaaatgctgagaacattgaaacttcagacggtcggagtactctagcccagaatgatttggtcctatgattggaacaaaaaatactggagttacagggagaacttgagcatgtccgcaacttggcaaacctctccctcaccctaaatgtccttgacatcaaccaacaaaatgctcaaaacccagcacctcctcaaaatacgccaaaccaacgtccacaaaatcatcccgcaccccatcaatatgtaactgctccccaaaatcctaatccttcacaagtacccactcctcctcaataccaacatcttcctactcagtaccgcaaaccaccgaccatactccccagaatatcccccaacctatccttaatctgtaaaactccactaacgatcaccactacactccaaaccccgacacccaccaaaacagtctcatatacgtggaaactgtaactcattctactcaaccaacatcatacactccagaatttgccaagaaggacctgctcattaagaacatggctaaagagcttaaaaagctcacgagccgagtccagggtgtcgaaggaggcaaaggaatcaaaggtttgaattatgaggatctgtgcattcagccagacgtggaactggcggagggttacaaacttcctaagttcgaaatgtttgacggaacaagtgacccaaaagtgcatttgagaacatactgtgataagctcgtggctgttggaaaagatgaaaatatgcacatgaaattgttcatgaggagtttcactggagatgccctatcttggtatatcagtcagaatcccaagaagtgggtcaattgggtaagcatagcattggacttcatagattgattctggtttaacacagagaatgcaccggatgtcttctacatacaaaatctaaagaagaaatcaacagagactttcagcaagtatgctactcgatggaggtcagaagctgcaaaagttaggccagcattagaagaagcgtagatgaacaaattcttcatcagggcccaggatccctaatactatgaaaggttaatggtcatcaaaaatcagaagttctccgacatcatcaaactcggagaaaggattgaagaagggatcaagagtgggatggtgaccaattttggggtattgcaagccacgaacaaagcattgcggtcagagggtatatcaaagaagaaagaagtaggggcagtaatggtagaccaaggcccaaaatctccacttacataccaaacacctccacccacataccaaccttcacctcctagatattctcaacctgccaccacctatcacacttacaatacccagccagcctattatcattcatctccaacccgtcaaaactatcaaaagtcgagacccaattttgatcgcaagccgcccagacaatatacccctgttgctaaacccattgaccaactatatgaaagattgaagtctgttggatatgttacccccattcctgctattgcaatggaaaattcttcccggtaggtcaacccaaacaaaacctgtgcatatcattctgtcatgaaagggcatactatcgatgaatgtctcaccttgaaagataagatccaaaccctgattgatacaaaagtcgtacaagcaaaagaagtcgcgctaaatatctacaataatcccctcccagatcataggggtgaaggggtaaatgtgatagagacttatgaagaataggattctgaggggtcaatcgggcttattggggaaggtgatgaccctaaatttatagtcacactcactcctatcgtggtacagatacacccgccagtcaaagttgaagtagtcgcatcagtcctattcgaaattgaagtaacatcacctgctactgcaccggatccatttgaagtagaagtatccacacccttcaccgtgacagtagtacccacacctcctttcaagtccaatgccataccttggaattacgttgccgaagctaggagaaaggaaaaagcaaagatggaagaatttggcgctgcacaggggatgaccagaactgaaaggatatatacacccgaaaatctgggaggaataagcaaggaagctgctaccaaataacccctcattgaaactggtccagatgatctttggaggaaagtacaggcaagagaatactctgtcgtcgatcatttgaacaagactcccacccagatatctatcctatctctactgcaaaattttgaggcacattagaatgctctgatgaaggtattaaatgaagcttacgtacccaacaacatcactagtggagagatggccaacagggtaggtcaagtactagagagtcacaagatcaccttccacgaggatgaactaccacctaaaggattaagttgcaacagggcattacatatcataatacagttcgaggacaaattcatcaccagggtcttaatagatggggattcaagccacaacatttgtccattgattactctaaaaaggttgggaaagatttccatgagatacgagaagggagcatgaacgagaaagcatttgatggatctcaaagggccacgattggggagattaacctttgtctgcagatgggaccaatttggttcgatgttgagttccaagtaccagacatatcagctacatacaatcttctattgggacgaccttggatacataccgctggggctatggcttccacgctacaccaggccatgaaattcgaatggaaccatcaggaggtaatcattaatggggatggaagtaaccacatttacaccagccaaactgttctggttgtcaagaatagaagaaggctgggtggagagacttatcactgcattgagcatgtcaacgcaattgagaaggacaagtggtagagtaacaaaatagaaagaatactggcatggtctaggtatgaacctgacaaagggcttgggaagaaactccaaggcattaccaaaccgatacagttgaaacatcacggttttgggatgggatatccatacacatgacaagaatataatgattggtcgccaccatagcgtggtccttattaccctctcgagcagtcagtgccacacctgagtcagacttttcacaaggctgatataatatggggctctgtagaggaagaagctttggctgggttgagaatttattcctagaagacgagaatatggattgcaatatttaaggaggaggaggaagaaggcctcaccattcagaccatagagaagggagttgttctcaagaattggactgtcataccatatcgggcccgccgagttcctaggtagcttggcaattagcctggcttgttttaatagccatgctaggcatttaagatattttcagtaattttgttttaaagacgcattttgtttcgaaataattgctcgatttatcgagccgcatgttttggaatttaattaatacattgctatttagtattcattattatctttcacatttttcttttacaatattataattactttttctgatgaaccgatgactatgacatgtaatgagacaacgcaatataaggatagtgacttagaagaagaggaggaaataccggaggaagttgtcagagaagttgagaattttgagaacaaacctaagtccaatctagacaaaaccgaagcaatcaatttgggagattccgaaaccatcaaagaaactcgcataagcattcacctatcacccttagagaatgaagaatacacttgtttcctaaaagaatatgaggacatttttgcatggttatatgatacatgactggtctgaggatatccatagtggctcataagttgcctaccaatccaatatgtccaccggtgaagcagaaactcagaaagctcaaaccagatatgagcctaaaaatcaaagaggaagtcactaaacagatcaaaggcaaagtcctcagggtagttgagtacccaacctgcttagccaacattataccggtttcgaagaaagatggaaaagtcaaggtatgtgttgactatcgagatttaaataaagcaagtcccaaggacaatttcccaccgccaaatatacacatcctgatcaacaattgcaccaagcatgaactccaatcctttgtagattgcttcgtgggttatcaccagatctggatggatgaagaagacgcagagaaaacaaccttcattatactgtggggagtgtactgatacaaaatgatgtcattcggtctaaacaatgctggggctacctacatgagagccatgacaaccatattccatgatatgatacataaggaaatagaggtgtatgttaacgatgtcatcatcaaatccaagagggccgcagatcacatagtagacttgagaatgttctttgacaggataaggaggtataatataaaactgaaccccgcaaaatgtgcattcggggttcccgcaggaaagctgttgggattcattgtcaaccgtcgaagaatcgagttggacctgtccaaagttaaggctatccaagagttaccaccaccaaagagcaaaaaggatataatgaacttcctgggatgcctcaactacataagtcgcttcatagcatagtctacagtaatatgtgaacccatcttcaaatgttgaggaaagatgctgaaaccagttggaccgaggattgtcagaaggctttcgacaaaatcaacgaatacctgtatacaccaccagtccaagtcccgctagaacctgggagacctttgctactctatctatccatattagatggggctttcggatatgttttgggaaaacatgacgagacgagaagaaaggagcaagccatatattacttgagtaagaagttcacagcttacgaagcacggtattctctgctagaacgcacttgttgtgctttgacatgggcaactcataaattgaggcattacttatgtgcctataccacatacctcatatccaggatagaccctctgaagtacatctttcataagttcatgccaaccgggaagttatctaagtggcagatattgttaagtgagttcgatatcatctatgtaacttagaaggcggtcaaaggacaagcattggcagaccatcttgctgaaaatcctgtgggaggagaatgcaaaccactaaaaatgtattttcttgatgaagaagtatcattcgtaggagaggacattgttgaagcctatgacggatggagaatgttcttcgacggagctacaaacttcaaaggagtgggcattagagcagttttggtatcaaaaataggtcaacattacccattatccacaaagcttaggtttacgtgcaccaacaatatggcagaatatgaggcttgcatcataaggctcaattggccatcgatatgaatatacaagagttgttggtaattggtgttcagatcttcttgtaccttaggtttaaggagaatgggctacgaaaaataccaagatactaccatacttgtatcatgtgcaggaattgatgaagaggttcacaaagatagaattcaatcatgtgcctagaatacaaaatgaatttgtagacgcactagccactttgtcatcaatgatacaacatctagataagaatttcatcgatcccatcctggtgaggatccataatcaaccagcttactatgctcatgttgaagaagaaacggatggaaaaccttggttccatgacatcaaagaatatttggcaaaaggagaatactcggaacaggaaaaccattctcagaaatgcacattgcggaggctgtccaatcacttcttccaaagcgtagggaccatgtatagaagaacttctgatctggggttgttaaggcgtgttgacgcaaatgaggcttctagattacttgaggagatacatgtcggaacttgtagaccacatatgaacggttttgttctagacaaaaagatactcagagctggatatttttggatgaccatggaaacagattgcatcaggtatgtccaaaaatgccaccaatgccaggtacatgcaaaaatgataaaggtaccaccaaatgagcttaatacaacaagtgcaccttggccttttgctgcctggggaatggatgtcatcggtccaatagagcccaccgcttctaacgggcaccggttcattttaatggctattgactatttcacaaaatgggtaaaggctgcatcttacaaagttgtaaccaagaaagtcgtcgtagattttgtcaaggatggtaatatttatcgattcgaggttcccgagtccattatcattgataatgctgccaatctcaacagtgatatgatgaaagccatctgtgaaaccttcaaaatcaagtacaagaactctacaacatacatgtctaaaatgaatggagttgtggaagctgccaataagaatatcaagaagatactgaggaagatggtagaaaatcacaaacaatggaacgagaagttgccatttgccctattagggtaccgcactacggtccgcacatcaactagggcaactccctatttactggtttatggtactgaagctgtcatttcagccgaggtagaaattccttctttaaagatcatacaagaagccgaactcagtgatgtagaatggataagaagccgctatgagcaactagccctcatagacggaaaaagaatgaatgcagtatgtcacggttaactttatcagaatagaatgtcctgagctttcaacaaaagggtcagaccaagacaattcgcaccggggcaactggtgctgaagcgaatcttccctcatcaggatgaagccaaagggaagttttcacccaactgttagggtccctacatggttcaccgggtgctaataggtggagcactcatacttgcagaaatggacggagaattttggccaaaacctatcaattcagacgcagtcaagagatactatataagactgtttacattccttcatttgatgtaactgaactacgcttgaccttgtcacacctcctttttaccacccccggaaggggtataggggagtttttccaatttaagtgacaatcaaaatgtgattatttaattaaaagagtcgccacttgggataatttatggtgtccaaattcaccggttgagaatcccgaatcgaggaaaattagactctattttatagtctgcgaacatagaaatctgggttaggaattctgttaacccgggagaaggtgttaggcattcccgggttttgtggttctagcacggtcgctcaactattattattggcctatttatctgattttaaaacacttttaaacctatgtgcattttaaactttatcaccgcttttaattatttaaagagttaattcaaggttatttaaaacacatcgcaagtcatgctacatgaaatgcacccgtgattcacaacatgttctatttaaccttgttggagattagagtcgggtcacatgaaatgtacacccgggttttaatagaagccacgataattatataattaacgcgcctaaagtaaactacgaagttcattattaatatctaagttataaaattagtatgaggaccataggtgatttaattagtatggcacacctcactctaagaataactggttcaactaggagattgtaaggctcttgactaatctaactcaagatttatctaactcaaaatttagtctaaagccttaattactgacatgtaacgaggtaattaaatgacctctgattacttaaaggaaatggaaccaactgcaggccatctgataaatcaacgaaaccccttgggctgaatctacagttgagcctagtattcagagcaaagggccaaagtccctcaacgatgaaattgggccaataacaggccccaaaagtaccttgaacgccacatttacaagtcttctctttaaacataaaacgcaaagggagaagggtggagctgaagactcttgggcctaaaattgtgcccaaatcaaaagaaaactttatctcgacggtttgggctccaaaattgagcccaccatgcagacgactgtcaaggatcacacttagagtgatcttgaccaaaaccattcattttggcctattcctgacccaattagttaatgacacacactgatattctgtatatacgtacagcaaaatacatacgtttgaaagctacaattaactatcaatgattgaacatccctaaccaattacacagaacaaataaacaaaagaaaataaatttatacaatctttaatcgtaataactaagtaatttgactacatcattgaaagaaagctccataaatcgttccatcctttgctaaggcaacatacttcctccttgtgattcaaaacattgttgagatttgcaaaactagctataaagctagcctgcaaatctgcatctgatcccttaatgcaacaggccaacgaaaacaaagttagtaccattatcacccttcattggtgtcaacacacaaggacatgcttaaccaaaatatccagattccctttatactacttcccaggttccgttagttgatttgccaaagaaaaacaaacataaaatgagaaaacaagtttcagctttcacatggatccttgtagactattttaagcatgatgactaccacattatcatacaaagcttgaaggcaaattttagattcaaacatatagtaagaagagaggtcatagttgattatcaacacatataacaagaatcacaccgagtttcagacaaagatgtgaatcagattcatactagtttaccattattcacataaaatacaatcgttgcataatcattccatttaataaaagagaaaaattgtgacgacccggccggtcgttttaagaatttgtgccccgatcccccattaactgttttccccaagtttatttctgctactttgatttgcagggatgttcggttttaagttttggagagttttgggacacttaattcctaaatgagaccttaagtgttggaaagttgaccatagtcggaacagtgtaaagacaacctcagaatggaaattcgatggttttgttagctccgttgggtaatttcgggcttaggggcatgttcggattgtgttttggaggtctgtagctaatttaggcttgaaatgccgaaaggtcgaattttgaagtttccggttcgatagtgagattttgatccgagggtcagaatagaattccggaagttggagtagcttcgcagtgttgaatgtggcgtgtgtgcaaagttttatgtcattcggacgaggtttgatagactttttgatcgaaagcgtatttttagagtttttggaattctaaggcttgaatctaataaaaaaaaataggtgtttcgatgttgttttgagcattctaaaggttggaaaaagtttgaatgaagttatgggatatgttggtaggtttggtcgaggtcccgagggcctcggaatgatttcggatggttgacggaaggattttgggactttggagttgcagcttcagttgttcttctgtcataaccgcacctgtgagtgagggaccgcatgtgcggatctgcagaagcagcggatctaccgtagaagtggaaatagaggaaaggcagcagggacagcagaagcggggtcttcaccgcagaagcggccccgcatctgcgaaaggatagccgcatatgctgaaagctgggccttaagtgaaaagtagcaaatgcgaccattattccgcaaatgtgggaccgcagatatgaaaacacctgggcaaaaatatgaaatttcgagggtttagtttcaaaagttggaaattcgatttggagctcgggagagggcgattttgagaggaaattgaagaggagatcattgggtaatgattctttaaccctttctagttatactacatcaatctatagttagtttcatcatttaatttcgtattggagatgaaaattggggaaaagttggaagaaagttcttaaacctagaattcgacttttgattgggaatttgaccttagatttggataattttggtatgcatgaactcgggagagtgtgaggattctaaaaatataaatgttacccgattccgagatgtgggcccaaggggtattttggtcattttacctaatttcgcgtagtagcttagaatttctttgtagaattagttacttgaagtcttatttatgttatgaaattgaattgaatagatttggaccatttggagtcgagtactcgtgataagagcatggtttcggattgattattgagccggtttgaggtaaatggcttgtctaaccttgtttggggaaccttccccttaggatttggtatatttggtaattgaaatgccttgtatgtgaggtgacgagtgcgtacttgtgctaattgttggaaatccggttttcattaagtaattactagtatgtttcctttcctattttaattacttgcactattaagcctgttgttagcttaggaaagcatgtctaagtgacttaattgctttacttgctcaaaccgccttacctaaattctgtgtagcatgctaggctagaattacttatttgtcttaatatgaaatttgccatttctaaatattttcctgtagctgctgtgtatttacattaggactacggatgtgggattctggtagatcccccttgtctgtttattttgggactacagatgtgggattccgataaatccccctgcatagttatatggaactacgggaatgcacctggtagattcccccagtactgggtatttacatttgggactacggaacgggattccagtagatccttgtgcactatgagttggactatgggacgggatcccgggagatccattggatatgtatatttgggactacatgacggtatcctgggagatccccgattgttattttggtactggaccgtatttctttctgtgtttaccttgtctctgtaatagttgttgttgccctttatatcttgtgttacttttattgctgtacttatttatattgttctgttctacactgtttaactttatattatttaacctcagtagggccctgaccttcctcgtcacttcccgaccgaggttaggcttagcacttactgagtaccgttatggtgtactcatgccctttctgtgcatgtttttcatgtgcagatccaggtaccttgactcggtcttattacccttgaggcgaggcgactgttccagagacttcgaagtatatctgccgcatccgcagaccgaggagtctctttctactctccttattgtattagcccttctgtatttcctttttcttgttagatattctgaagttagacactagtagacgttccaaggcttttggattcatgggtttttgggttttgggaaaatgtattagttttgaggatttatattgtgtatgccgagcgacacgtttaaacgctgttatatcactctatttctgttttaaattattttcttccgcaaattggtttatcttcagcattttaagcttacctagtcgtagagactaggtgtcgtcacgatggttcacggagggcgaaccggggtcatgacaagttggtatcagagctctagattcataggagtcatggatcacaagccagtttattagagtctcgctgatagatacggagatgtctgtacttatctacgagacactatgtaactattaggaaaattccacttcatttgatttccttgtcatgcgatattttgacatcacaattctaaacttttgtcttctattatcttacaaatggtgaggacacgtgctacttgagatgcttaggcacatgcgcccctactgcagtcgtcaaaggacggggcctggatagaggccaaggacgtgcacgtggtgcagccagagcacctacgtgagctgccgccgaggtaccacaagcagttctagctgaagtccaggcacttaacatgcctactgctactactactccagctcttcaagagactctggcacagttcatgagcatgtacaccactctggctcaggcaggattgcttccccttgctgcagctacatctcaggccgggggaggagcacaaactcccgccgctcgcactcctgagtagcgagtgcatgttgagcaagtccttgagattattcatgtactgcctgcagtgccagttcatcctgagggcaaagcagcaacttccgaggaggaacaattgaggcttgagaggttcaagaggtacaagcctcctatattcagcggtctagcatcggaggatgctctaggatttctagatgagagttatcgcattctgcgtaccatgggtatatcggtatcgagcggggtttccttcactaccatctagcttcgaggagccgcctatgagtggtggcaaacctatgagttagacagtccaaatgaggctgcttcgctgacttggacttagttctcagatatgttcctgaaagagtatgttcctcagagcctcaggaacacatggcgcgcagagtttgagcatttgcactagagtactataactgtctcagagtatgttgtctgtttcaccagtttggctaggcatgcaccggccttggtttctactgttcgtgagagggttcgccagtttattgagggccttattcccagcatcaggtctagcatggctcgtgagttggagatggatatttcttataagcaggtggtgagcattactaggaggattgagagtatgcatgctagggaggtagaggagagggaggccaagaggtctcgagagttgggccatttctctagtgttcgtgccccaacagccagttgttatggtaggggttatatgagtcgccctattcattcagctcttctatcagccagtggcatttcagctccttcaagacctcaggagccttattatgcaccaccggtatctagcgcgccttctatgcgaggtgctttcagaggtcagtcgagcagacctggcccgagccagtcatagccaccacgtcctcctagagattattttgagtgttgtgacacatgccatatggtgagggatttacctagacttgggaggggtgcacctccatagacttctcagccacagcgtgccccgcagagttctcaggccatggttacagctatagttgctaccccacctgctcagccaactagaggtagaggtcggagaggtagaggtcgccctaaaggaggaggccaggccagatacaatgcccttcctgcccgtaccgaggttgttgcctccgattctgtcatcacatgtattatactgctttgtcacagagatgcatcggttctattcgatccaggctccacttattcttatatgtcttcttatttttctctacatttgggtgtatcttgggattctttaagttcccctatttatgtttctactcttgtgggcgattctcttgttgtggaccgcatttatcggttgtgtttggttgctcttagtggttttgataccagagccgatttattgctgctcagcatggtggattttgacattatcttaggcatggactggttgtcgccccattatgctatccttgattgtcacgccaaaaccatgatgctggctatgtcaggtgtaccgtgttgagtggaggggtactttagatcacactcccagtagagttgtttcttttcttaaagctcagcggatgattgagaaggggtgtgatgcatatttagcttatgtgagagatgtcagtattgataccccttcagttgattcagttccagaagtataggattttcccgatgtgtttctagctgaccttttgggcatgctgcctgatagagatattgattttggcattgatctattgtcgggcactcagcccatatctattcctccgtatcggatggctcctcctgagttgaaggagttgaaggatcagttacaggaatttcttaacaatggttttattcagcccaatgtatcaccttgggtgctcctgtcttgtttgtgaagaaaaaaatggttctatgtgtattgattatcgccagttgaacaaggttacagtgaagaaccgttattctttgcctcgtattgataatctgtttgaccagcttcagggcacacgggtgttttctaagattgatttgcgctcgggttaccatcagttgaagattcgggagctagacatctcgaaggctactttcaggactcggtatggtcattacgagttcctagttatgtcatttgggttgatcaatgccccagcagcctttatgcatttgatgcacagtgtgttctggccgtatcttgactctttcgtcattatctttattgatgatattctggtgtattcctggagtcgggaagatcatgagcagcacctcaggactatgcttcagactttgagagagaagaagttatatgctaagttctcgaaatatgagttttggttggatttagtagcattcttaggccacgtggtaacgagtgagggtattcaggtggatctgaagaaaatagaggccgtgcagagttggcccagaccatcctcagctacagagattagcagtttccttggcatgacgggttactacggtcgttttgttgagggattttcatcgattgcagcccctatgactagactaacccagaagggtgctctgttccagtggacgaaggagtgtgaggcgagctttcagaagctcaagagagctttgaccacagccccaattttgataatgcctacaggtttggggtcttatacggtctattgtgatgcctcgaggattggcctcgaagcggtgttgatgtaggacggtagggtgattgcctatgcgtccagacagttgaagatacaggagaagaattaccctatccacgaccttgagttagctgccattgttcaagccctgaagatcttgaaccattatttatacggggttccctgtgagatttatactgaccatcggagcttgcagcacctgttcaagcaaaaggatctaaatttgcgctggaggagatggttagagttgctgaaggattatgatatcaccattttatatcacccgagcaaggccaatgtggtggccgatgccttgagtcgtcgggcagcgagtttggggagtttggcttatttaccagcatcagagagacctatggcaatggatgttcaggccctagccaaccagtttatgagattggatcttttggagcctagtcaagttctagcttgcgtggtttctcggtcttccttatttgatcgtatcaaaaagctgcagtatgatgaccctcatttgcttgtccttaaggacaaggttcagcatggtgatgccaaagatgtgactattgttgacgatggggtataaaggatgcagggtcggatttgtgtacccaatgtttatgggcttcgggagttgattctggaggaggctcatagctcgcggtattccattcatccgggtgccgagaagatgtatcaggatttgaggcagcactactagtggaggcggatgaagaaagatatagttggatttgtagcttggtgccttaactattagcaggtgaagtatgagcaccagagaccgggtgggttgcttcagtagatagagattccggagtggaagtgggagcggatcaccatggactttgtagttgggctcccatggactttgagaaagttcgatgctatttgggtgattgtggatcgactgaacaagtccgctcacttcatccctgtgtgtactacttattcttcagatcagttggtggagatctatatccggaagattgttcatctgcatggtattccagtttccatcatttcagatagagatactcagttcacatcacgattctagagagtcattcagcatgagttgggtactagagtggagttgagtacatcatttcaccctcagacggacggacagtccaagcgcattattcagattcttgaggaaatgctccgtgcgtgtgtgattgagttcggagtgtcttgggatcagtttttgccattggcggagttttcttacaataatagctatcaatccagcattcaaatagcaccgtatgaggctttatatggtaggcggtgtagataccggtgggttggtttgagctgggtgaggctagactattgggcacagacttggtttaggatgctttggagaaggtcaaggtgaatcaggatagacttcgtacagcctagtccagacagaagagttacgcggatcggaaggtttgtgacatttcctacatggttggataacgggttctgcttcgggtttcgcctatgaagggcgttatgagatttgtgaagaaagggaagttgagtctgaggtttattggccctttgagatattgaggcgtgttggagaggttgcttatgagcttgccttacctcccagcttggcaggagttcatccggtatttcatgtttcgatactccggaggtatcacggtgacccgtcacacgtgttggatttcagtttagtccagttggacaaggatctatcttatgttgaggagctagtgtcaatattggacaggcaggttagaaagctgaggtcaaagaatattgcatcgataaaggtgcaatggcggggttaatcggtcgagaaggcgacctgggagaccgagcaggatatgtgcagccattaccctcatcttttcactacttcacgtatgtctctatgctttgaggacaaacgaatgtttaagtgtaggaggatatgacgacccggccgatcgttttaagaatttacgccctgatcccctattaactgctttccccaagtttatttctgctattttgatttgtcgagatattagattttgagttttggagagttttgggacacttagtccctaaatgatagcttaagtattggaaagttgaccgtagtcggaacagtgaagacggccaaggaatggaaatctgatggttccgttaacttcgttgggtgatttcaggcttaggggcgtgttcgggttgtgttttggaggtccatagctaatttaggcttgaaatgcttaaaggtcgaattttgaagtttctggttcgatagtgagattttgatctgagggtcaaaatggaatcccggaagttggagtagcagtgttgcatatggagtgtgtgcaaaatttcaggtcattcggacaaagtttgatagactttttgatcgaaagcgtatttttagagtttttggaattcttaggcttgaatccgataaaaaataggtgtttcgatgttgttctgagcattatgaaggttgaaacaagtttgaatgaagttatgggatatgttggtaggtttggtcccgggggcctcagaattattttggatgattggcggaaggattttgggactttggagttgtagcttcagtttttcttctatcataaccgcacctatgagtgtgggaccacaagtgcggagccacagaagcggaaaaggaggaaaggcagcagggaccgtagaagcggggtcttcaccgcagaagtggccccgtatctgcgaaaggatagctgcagatgcggaaagctgggccttaagtgaaaaatcacaaatgcgaacattgttctacaaatgcgtgaccgcagaagcggtcccaggaccgcagatgcagaaacagctaggcggaaatataaaatttcaagggtttagtttcaaaagttgaaaattcgatttggagttcgggagagggcgattttgagaggaaattgaagaggagatcattaggtaacgattctttaaccctttctagttatacaccatcaatctatagttagtttcatcatttaatatcggattggagatgaaaattggggaaaagttggaagaaagttcttagacctagaattcgacttctgattgggaatttgaccttatatttggataattttggtatgcatgaacttgggacaatgtgaggattctgaaaatataaattttacccgatttcgcgatgtgggcccgaggggtgttttggtcattttacctaatttcgcgtagtagcttagaatttctttgtagaatcagttacttgaagtgttatttatgttatgaaattgaattgaatagatttgggtcatttggagtcgagtactcatggcaatagcgtggtttcagattgattattgagccggttcgaggtaagtgacttgtttaaccttgtgtgggggaccttcccttaggatttggtatatttggtaattgaaatgccttatacgtgaggtaacgagtgcgtacttgtgctaattgttggaaatcatattttcattaagtaattactagtatgtttcctttcctgtttttattacttgtactattaagcctgttgttagcttacgaaagcatgtctaagtgacttaattgctttacttgctcaaactgccttacctgaattctatacagcatgctaggctagaattacttgtttgccttaatatgaaatttgccatttttgaatattttcctattgttgttgtgtatttacattgggactacggatgtgggattctggtagctcccccttgtctgtttcttttgggactactgatgtgagattctggtagatccccctgcacagttatatggaactacgggaatgcacctggtagattccctagtactaggtatttacatttgggactacggaacggtccgatagatccccatgcactatgagttggactacgggacgggatcccgagagatccattggatatgtatatttgggactacaggatggtatcctgggagatccccgattgttattttggtgttgaaccgtatttctttttgtgtttaccttgtctttgtaatagttgttgttgccctttatatcttgtgttacttttattgttgtacttatttatattgttctgttctacactattgaactttatattttatttaacctcagtagggccatgaccttcctcgtcactatccgaccgaggttaggcttcgcacttactaagtatagttgtggtgcactcatgccctttatgcgcatgtttttcatgtgcagatccaggtaccttgactcagtcctatcacccttgaggcgaggtgactgttccagagacttcgaggtatatatgccgcgtccgcagaccaaggaatccctttctactctccctattgtattagcccttctgtatttccttttccttgttagatattctggagttagacactggtagacattccaaggtttgtggattcataggttttcgggttttggaaaaatgtaatagttttgaggatttatattgtgtatgccgagcggcacttttaaatgttgttatattactctatttctgttttaaattattttcttccgcaaattggtttatcttcctcattttagtcttacctagtcgtagagactaggtgctgtcacgatggttcacggagggcgaattagggtcgtgaaaagtactattgtacaagaaaggaactggaaagagtaacttgaaggagtaaaaacagaaaaagagtaatagccaagcaataggaagaaaaacccagcaacactaactcagcagcaacaaggatcagtgatgaaataaccccagcaaaccagaaatcctttgaattttttttttgttcttccaagagtaatcccaaccaattttgagccaaatgatgcagaaacttgtcagtattttttagggtatgaatgtttgatttttgagtgaaagaagggtctatatatagccctttttgggagccatgtgctgcaaaaatagaatggaaattattccctcacacaagcattttttttaacagaatgggacaactgtcaacctctaattggtttcagcaatttgtgttggccaaatagggccagctgcccctattttagaacactctaacatgaattttatccaatttcagaattatttgccctcttttatgaccttcttaactttctttttgttcaattaggtccctataagttgctactgatttgcaaatcagggtaaacaacaaatgggcatactaatgtaaatcaaataaccaaatttaacaatgatagaacttttaaatttctggacacctaaacaaacctagaatgagctaatttcaataatgaacaagtagcaacctaattctaatccaaccacaacaaaatgtgataccaaacaaatcgaatttaagaggtgaacagtgaagcatgactgatattgagcattcaacaatctgactcctaaaaccctacatctaaaaccatacaattaaaatgaagaggaaattgacagaaaggcatgacaaactagaaaaacagaattcatgatgacctaacctgaacaaactaagaaattatcataaacatgaataacgcctaatttaattcaaacaatctgaataataccaactaattggagaaaataaatagcctaaacaaatttagatgaacagatgttttaaaaattgaaaaagaaaatcagaaaacagaccaaaaataaaaactaaagagaagaaatgaggtactggctaagcactagaatattctatcagtccagagattatggctaccctaattccttcattatttttttcggccaggagaaaaggaacataaagaaacagattagagaaaagtggaagcaaaataggagtagaaatcacagaaatagatagaggaaaaaacaaaagaaatacctagcaattgacttaaagaattctggctgctccgattttaagcccaaaattaatgttaatcgcatgttctttgttaagaaaaacaaccaacatcaatttcacgctaaatcatccttggaacttgaaggcttggggcttaaccttgcatgccacaaatgcgaagtcgggtagatttggtcgagcttttgaggaaactattgaggggtttgggtttatgggtgtgtgaagactatatggtgcgattttgggtggatttggagactttagggttttgggtgttgattttagatctaaaatccgagccgtttgggagggattcgagggacatagattagggatttgggaagaggaagcaatgggggttctggagtgttagtttggagcggattggagacgtttatggcgtcttcgctggcggagacggtgggggattttggggtttttagggcggcggctagggttccaagtctctgaacttgagagacggggaatgagggggagtggaatgggggggggtgcttgggttcggacagttaaatacacaaggtgaccctagttccggtccgttggatcattgaaatccaacgctgagatgatgaagctcgaaacggggtcgtttggttgagacaagggagctggaccgggtttaggggaattgggcttggatttggaacggatggaggggagatttgggctccaccaaagcttagcccaattgaatcagcctttgcaattaacccatttgttttctattcttttaattcctttctttttatttgtcttttcttttcttttctttttttaaaaaactaccaaaattaaattcctaaattaatctaaaatacaaaattaagctaattatctgttataaaaattataaaaatcacttaattctaaattaaagagaaaaatcaataacctaaagatttaaaggtaaaaatgagctatttttgtgattttcaatttttataaaactagtctctatgcacatgcatcgcaagtgtactccatatcattttcttttacaagatgcatatcaaagaatagttagaaattgttaatatgcatatatataggaaaaatgcataaataccccctaacctatatcctgattctcaactacacgctttatctttgcgagaatcttattattcctctaaattattttaaagtagaattatttgcatccttaaagctggcgtggaagagtgtgtgtatgggagagtgagaagcaagaaaaaacgagtttcagatttttctttttgcttttttaccactttttttccttttccttttccttttccttttccttttcatttttcttttactttttttcctttcttctctaattccggcggatattcatttaccgacgactttatcttactgcttttcttctatttattctgtttttatttttttctctttctatacttttcacacacaaattaaactctcaaaaagatctatccataatcaaagcaaattaaaatatagattgggataaaaatatgtcgccgggaaaaaaaattcaccttaaaaaatggtgttcttgaaattccgacgaccaccattttatgccgccggtagccaaaacaaaaaaaagagaatgaaataaccaaaaagatgagaataataagaaataagaaaaaaaggataagaaaaagaagaaagaataaaaaatactaaaaatacatgtggcagcacgtgtatttcaccacttgccaagagtttggttgtctagttttaggatggtatttattccatttaaaaataatttaggggtaataggatttctataaagataaagtgtgtaattgggaatccgagtataggtgtgtgtgtgtatatatatatatatatatatatatatatatatatatatatatatatatatatatatatatatatatatatatatatatatatatatatcacggaaaaatatttgattgggtaataaattagaaatttaaatataccaaaacctagcgtgtccttgagaactttttacgaataaagccgaaaggcatattctctatccaaatcaatctttgttgttttattatgacactattaattaaaattcgttatatactaaatccggatttgcgacggaaaattctacattgggggtaaagcgctccctaataaaggcgactttatattcagggactcaaacccgagacttctggttaaggatgaaggagtacttaccactccaccacaacccttgttggtccctttttcctatttcaatatacatgtcatgcacaatgtttttttgtttcctcgtatacagctgtttatttaaacactgataataagtgttagagttcaaatctcattattggatatgaatgattaaattgcatattaagtcccttttttaatctactgaaaattaggtaatcgggtataataaaattaaagaaaatatccaaatatgccatgtaatattagaaattgctcatttttatatttttaataaattccttgagttagatatatcatcgtggaatatgaagggtttaaatgcataatgtgtcctcttttatacttactgaaattactgaaaactaggtaatcaagtgagattaaattacaggagaaagtccaaaaatggccttgttaatcataattgaaccaaataatgacactccaaaaagtagtagcaaaaagtgataataaaacaaaagaaatgaaatacagaaaaaagtaaaatataattataaaggggcacctctattacatgagctcactatacacccaaaatacctggactaaatactctaacattgctttaagaaaaatggccatacaaatgaagtccaatcttcataaaatctatgctatgatttttcaaacaagactacaatatttattcacctctgcagagtgcagaaagttaattccttggcccaatctcccaacaggctttagaaagcatacacatatgcatttattactttttatttgtaaaagaaaggaaggatatttcgattagataatctattgatgtatggatcagaaagcaggggtagggcaggggtaactggaaatattacaaactattacgatacaataagtcctccgttttgtggctttaatagaatccgtttgccaagagattggaacttaagaaatcatttacagttggagataacctttctttcttcctctcacttatttataagcgtgtaacagctatttcacgtgtaacacttatttcatgaaaatcttcaagtgtgttcgagcaacagttagggctcgtttggtacgagggataaagaataattaatctcggaactaaatttaaaaagagtttatctcatatttggttagtagaaaatttctgtataattaatcccgtaattaattattctgggattgtagtatttttttatcctcataaaaaagtgaaataactaattacgggataactaatcccgtaataattaatactgggacaacttctttctaaccaaaagaacccttattctattaacatgccataatacccttctcctggatatagtaatagtaaaagagtgcagattgcaacagatcgtttcacgtgtatgagttagttattattcaatagtaaagataacttttaaaacacaatagcacttgtttagctatcaaatttcagagtaaaaggtaaacaaactaatcaaaatttcttttttgacactctgaatagttaattttaaaaaaataacgaaaaagagacatccaactcgaaacagaacggagaaagtaacttaaactttctttcaaatagaagggggaaaaatgcaagcaatagaaaatagaggatgtaaaatttacctgtttgcaacgccacaaacgacagtgacgccggcagcctaattgaaccgaacactgacacttcaaaaagtagcaaaaactggaaattcactgccaatatatttgttgctggaatgaaaattctctttttgaaatatttttaagggtaattaaaagccttaaataacaataactgttaataaagatcaaagaaagtcgaaaaggggatcatagccgttgtgaaacactaactctgatgcaaattgcagatatttattccaaatagaatatttcgtcctttttttatattttattttggggaggggattaattttctcctaatgattttgtaaataagtgaaaatttgcttttagatcaatctgtagatgttacatcctttcatgagatgatccttataagtaactttccggaaggaacacaccccttcatatggatgagtacagaagcgtggtaatcagattcttagtgacggttcaaataaggggtattataggggttttcttattaaaaaataaatttattaagaaaagggtaattttataatttaactttctactgaagagcttcctctttttaatagattatagaaaagtaattactgattaatcctaaaaatgtaaaaataaaacctaaatgcaatgcatggtatttttggtatttttcatgatttaaataaaacttaaacatgcatagaaatgcaaacaattagcacaaatttccacaaaatcctataaaattgcaaaaatggaaaaaatgcttttcttatattttctgggagaattcctatagggcaaaaatcacgtgctcacagacctaattctcgtttaagaggggatacataggcagccttgtgggttcggttacatcttaataaaatcttcatttccccagaaccagaaactgagccagaattttaaggagggccctcaacattccggaataagtccagcccgatgccatcatatgcaagacagttagaaatcggttaagtaactggggaagaattttgaaaaggattctcaaaattctggagcagatccaacaaacttcgttgcacgcagaacggttgaaggatcaaactggggcagaattttgaggaggaccctcaaaattctagtgcaaggaagccgcaatgtctctaaaagtgttacagtcattagttcatctaattcacttgatattatataccattatgtttctaaataactctatttcatcaataagtgcatattttcgaaaactttatttctatggccgccaggtgttactcagggtaactcgaacaaggcctccagaacagagcaaaacaaagcaagcagacaaaggcacgaaccaatctttcccccaaaactcgcgatttttctttgggtgcaggcacagtgaacataacaggagtactcgcaaatatacacatatcaaaatcactatcctcataaatcggaccgacgagcgcaaatatatctccagctaagaaatattttgttcttatttgctatttgtctattgcataaggctaagcattgtcttctctttgcatgagactaagccctgtctcaaatcttgcatgaggctaagccatgcctccatatttacataaggctaagcactgccttctctttgcatgagactaagccctgtctcgaatcttgcatgaggctaagccctgcctccatatttgcataaggctaaacattgccttatctttgcatgcgattaagccatgtctcaaatcttgcatgaggctaagccctgcctccatatttgcataaggctaagcattgccttctcttttcatgagactaagccctgcctcaaatcttgcatgaggctaagctctgcctttatatttgcataaggctaagcattgccttctctttgcatgagactaagccctatctcaaatcttgcatgaggataagacttgcctccatatttgcataaggctaagtattgccttctctttgcatgagactaagcatcgtctccctttcttgcatgaggctaaatcctgcctccccaattgcacaaggctaagctccgtttttccctgtctaatgttgaatgttacactatctgaaacctagcgctactttgccttttccgggactaagctctgtcccgattctacacaagactaatctctgtcttgtttacttatatgatccatcatcatggctttatccgaaggcgtcagtccgaaggcatcatccttatagcctgaagacaccatgtcatggcctaaagatctctcaatactgcacatcattattcaaaggcgtcatggttcagaggcaccattttcatggcccgagaacatcatttcttggcatgtgaatcccttatctcatgattcatggcccatgaagtcatggtctaaggacgccatcttcaatatccaaagacaacctttcatggtccaaagggaatttatatcatgtttaaattctcgcagtaatctatatacttgcatgcattgtgttttaagttttacagaaaatccaggaggtaaccgttcttcaaacaggagcaaccttctctctggtttccgctcataccatttacactttgccattatttcaaatataaccgattcccatcaattgctcgccttcactccatgaccattcagatacctgccttatgatagatcagttacgattcagatttgccttcataactccgcacaaacctatccgatactacccttctcaaaagaacctttttcgaaacatacttccattcctatagaaattccatcggtttcattcaccattgggtctagaactacacattgtaaaaccaggaatatgtaggcagataagagactagggttcggcctatgtttttcaaaacacccccattcagtcaaactcggtcatcatttctttgtccgataactctttcatccttccgagataaagaggggcagttgttgatacccaattttttctcatatatttttaatatgcatatatattttcaaaaatagtgcacatgcatttacaaacatgcacaagtgtttctataattttttctataattttaaatgctttcaaccactttatttctgcagttttactatacaaatttccaataattatccctcatattattttttatgatgatttaatcatctaccttcatcatttatgtccaaatagtgcttaaatattttaatggcattttttataattacatttgcatttttcaagctagaattgcatattttgcaataatagcccatgcatatgcataattatattatctatacagaaaatgactttttgtattttataatgtcaagtaattattttaaatcattttcatgtacaaataatatttttactatttactaaattatttactgatttaattgggtatttaagatctatcccttttttaattaatttcggacctagcccaattgtatataccagcccaaaacccaattacccctacccaattaaaccacccgacctggaaaccccttaaatcaggaccgttgatctttaagatcaacggtccacaccaccctagcctcttttagcttaacaaacccaaccctaatccctcataaccccaaacccgcagcccttgaatgctctcaatctcccctctttcactctcaaaccctaagcggcgtcaccccaaatctccaccaaatcccctttgattccaaccatatatggaatcatctggtgatttcttaccttattcggttctctttctctactagctaatcgattatggtgttacataatctcttgcctaacatggcaagtggatctctcttgttttgaaccaagtttggttcgaatatttatctctttccatctatgttctttctccgcctccttatggtttgaatctctaagattttttgcttattccttattttaccctaaaagctagggtttatctcctttgaaatctgctaagatttggtacttattttcattaaaaatcatatctatgtttccacatgactatctgtgaatcttttcatgatttcgttaaaaggttttctgcctcattttatttaccctaaaattagggcccagatcttttcagatctgtcaaggttccttaattttgagtatctttcctttaatatttttgtgtatctatgtgtatccatgttattcctatagttgtttctttaaaataatttattcttcctaaaattagggtttcagatcttctctagttcgattccttgtgcttttcgaataaacctcttctctatgttcattatacatagtgtgattatttttcccttgtttctctgctgactttatggtttacccaaaattagggttttgaaaccctttattgagatattaatctttccttttctgtgcgatactactactttcttattttgttcgatttacatgttcttaccttatttggaccaatgtctgattaataatttatgctacttcactttgacttgccttactggcctgattttatgttctggttattaaaattgacttctaattaattttggaattattccttaccttatttgactactgattaagtcagttaactgatgtcagcctgattttatgtctattaattgatttatgccgaccttaactgattgttaattgatttttcataccttatttgcgtgtgattggttcattaccttatgtgttctactctattgtatgatataaaacccttcattattctgattttcaaacacgctcagacatacaagctcacacctacacttatacacttacactcacacaacttgagttctttctatcactctgatttgctgcattgtctagtcggctgaaagacaaggctagactcttggattcctattgccttcaccttcctatttactttctccctaactggtacgtcttaattcctgttatcttgttctattctataggcttatgtagtcagttttatcacagccctcaacatgcttctgtttgatacacgattcctgactacctctttctcaactgttatgccttagttcttgttgtcttgttctgttccatgtgattatatgattagtttacttcaaacttcaatatgcttatgtttgtcatatgtttcctgtttgcattcttcctgactagtatgccttaattcctgttaacctactctgttctatgtgattgtgtggttagtttaccttagcatgtctggccattgatttctatttacatctttttagactagtatgctttagttcctgctatcatgtgctatgtgtttgcttggttagttatttcaaacttcagcatacttttgttcaatatacgcctatatggtcccacctagtaataattaataaactaagtaatctttagtaatgtgaaaccttgatggattcagttgtatgctccttattcagaacaggtttaggtattgccaatatgtgtggtcagactgtctgtaattcaagtatttttgtccttgttgtgattgctttaattctagtatatcatccatgtctgaactaataccaatctactaaagatggactatgttctgttagtagtcttgtaatttgaacctatttgttcataaaaaacaaattgttttctaaaactgtcccctaccccttacatatactatttttcaaacttctactcttagctatctaggttcctaccacctccagtgtaagcactgccttgggtccttgagactcctttgaactctgacacattggagctggtttccaatctcttatgaattctgagttgaatgtgtggatccagtgtgagcattgcccggggtccttgaggctctttgggaattttgacacactggaagcctggcttaaggtgttgtggatccctgctactgtttcaagactgttgtgctgaaggcctggttctctggtttatattgggcctgctaaggcttcctatagtgtaatagatactgttatatagtttattcattttgggctgtaataatttctataataaacagatttggggtttgttagtaaaagctggggggtttattttatatctttgcttgaaattcgggtagaaatcctgcctataggtttattggtgattatgtgagcattactacttgcttagagatcatgtctataggactttctcattgctttgttctgtacttcactcgcatgctagaaatcatgttcatagattctttgcattagaaatcctatacataggatccatgcacatttttagatgcattagtagccatgtctataggatcctatctgttttattaataattttcctggcaatgtatttaaagaattctgcccacacgtgattaatagatatcatgcctataggaactaaaaatcaattagacaccatgcctataggaaataatggaatcaatttcaaacctagaaatcatggctataggatttaatctaatagatatcatgcctgtagggtgaaatcaatttgtaaacttagaaatcctgcctatagggggcttaaattaactagaaagcatgcctataggatctaaagagatagaatctgttaaaatcagtaatttgtttagaataaggttgtattgtggtccgggcccgggccaaacgggcctgggctttggcggtcccgggccaaatggtcccgggcctaacgggccaaatgagtagaaccgcccaccgcggtcctaagcccacatggtctcgggctaaatggggcgggcccgtggacctaaacgggcctaaatgagcttttttgttccgggctattttttaaatttttttatctaaggcaatttcttgtaaactatatatgtatatactaatataaattgcttatatatagctatataaatatatatagtatatatagtatgtatatataattatatattgccttatataatatatagcttatatatattatatatactatatctataatatatatatctacatatatatatatatatatatatatatatatatatatatatatagtttatatctaatacatataagctatatataaggcactatatatatatccaatacatataaactacatatatatatatatatatatatatatatatatatatatatatatatatatatatatatatatgtgtgtgtgtgtgtgtgtgtgtgtctatatatatatataaatatatagtttatatgtattggaaatatatatattgccttatatatagcttatatatatatatatatatatatatatatatatatatatatatatatatatatatatatatatatatatatagtgcaatatgtagatatagtatataaaatatatataagctatagatatagttcaaattaaagtttacatttaatactcggtatcaaagctgcaaattaaagtttacatttaatacttcaaattaaagttcaataccttcaacataatacttcaaattaatctaacaaactagaacattaagcataatacgtctaataattttaaaataacacaaattatctcaaatcaacttaaaatcttaaatacgaatgtcttgagaacgcgcaagacaactctttatatgcctccttaaagagcctgtgccctcctttcgacgacgagtgtagactcgaccacagttcttgcactttattatgtaaacttcttcattttcttctaccacattaaagtgttccaaaataaatgggtgcaatctagaatcaccgggcatgatttaacttgaattaagaattggagtttgagaaatgagagatgagtgaagacttgaatactttaatttgagtttgagaaatgagagagattgatgaatttgtgagtaaaaataaaagaatgagagggtatttatagttgagaatagggaaaaagtgtaattataaaaaggttggggttaaaacaaagtttgggagccaaatggctatttctgaaagtgccaaacggctaaaaatgcagtccagcggctacattttaaatatctgaccattgtccctttttaaaaaaaattaaaaaaattagtcgttgggcccatttggcctggttgaatcggcccaggcccgcctgctggtcccggggtaaacggtcccaggctcacgggatttttggtaagtaccagcccgctatgggcttttgcaccactagagaccggcccatttgagaccggcccatttggcacgccgtcccgggctgtgcccgacccacaatacacccttagtttagaaaccatgctatatgtttataattaacaattgtagataccatgcctataggattctgttaatcacttaggcaaacctgtaaggttactaatgattctgggcctaaaaatgctaatatttactgcctgaagatgcccagattcgaggcttaataaaatcagtaggcaaaactgatagggcgggataggtccagatgcccgccttagtaaactgttgttctgtattctatttttgctcatctagatatcctgtctataggatccttaattaaagaaacctgttgatttaattgcgtgcattcgttgtctacatgtggaggttaatatgagcccttatttgctccttacatgatagtcctatctgaattttgtttgtcgcctagcttttctcattttaaacaatataggtcagtctagaactatccaaaatagagttcctaaatacctccaggatcataagtaagggacgggtagtgcacgcataaggtacgcattagaagctactagaacgcttaggtaacaactgaaagatagtaatgtggtagtaaagaaaatgatgacccgtacgctaatgctatgtatagcaccttcacctgggaaacttaccaagtattgcatgaaaatgatcatataggctaaaaaacctaggacccctctaactcatgtttaaagtaatgtctatttatctaaattgtttaattcgcttgtttaagttcggtcaggacccatcattgtgggccttgaggggtgcctaacaccttcacctcaaggtaatttcgagcccttactcgatctctggcgacgtaactggttatatgagttaattgttctaggtgccctaacgcaccttaatccgttaggtggcgactcttcaaatcccttacccattcccaaaaggaaaagagttatcccaaaatatcgaagcccgatttcgcgagaaaaagggggagcgacatacagtatctgagatttctctacaatcaacctcgaatactggctgggattatcctcgaatatcgacttgttctaacaaggaaattattttgaaatggaagggtcttgataggtgagatttattgtaagggccaaacggtcaaaacgaactgtgcccacgtagattctcgagcactaacataaaacatgtacatgtatgactacttttgacaagaataaagagaagtactttccttgcagctatcttatgtcttagaaaaatttccactttacaatcacgtactttcgatctcttaagaaaatgggctcaagggccaattataaccaaagttcgtatagtcaccccctcaatcaaggactgccgttcggaaaccaacttcgaaatagatcgagctattaaaatatcagggatgcaagacctatcaagcagcccccaaattttaaaggcaatagcgatacccactcggagactgttattttaggcaagactggataactcggggaagcaagcccattgagctacacccaaaattaaaaggccacgaccatattagcatgactcggagacgtccgaaaaccgtaataatataggcctttgaaattttcataaccagttctaaaggctaatccttgaaactatattttgagttacttatttcgggagaaagttcccgatgaaaccaaatccaaagcgcctcaaaactaaataatgtgaaggcagggtttgttcaacttgagttgttttgtgctaaggcactctgacctttgtaaatacaagcaataaaacaaaggaatagtttgagagccgaaaatggtagaaagctttatatatatatatatatatatatatatatatatatatatacattctttttataaaggccagataggccaaatataaaatttacaatggccaaaatggcataaaaaaagatacaaaagaaagcaaaaatacaaaggcctaagtagcctggttttcgtcggaggcagcatctccatcctcgagatcttccccatcttcggatcctcttaggctcttggagtcttcctctggaaaggccagtttttaggctttgatctcctctgcttttgcagtcttgagttcagccacaatatcgaaaccttgagcctgaacctcttcaagggcttcccttcgagcttgccattttgcatgatccaccatgctcttggccttcgcctagatgacctcgacgtcaactttatattgtgccactttagcatcagctttggtgttggccatggccacctcaagttcgtttgccaagttcgccttatcggagatggccgacaacaactgacaggcatttaatgcctcagtactcgaaccgacgggacatttcagtatccacttatcgctgacatcatggtcgggttcgtcgcttacatcatgacccattgagataggatttgaaaagttcatatcgtttctcgtcgtcttctttccgagaaatgaggggactatctctatacggtcaaagtcgggcttgccctttcttgtatgactaatcgagactagaacgtggcaggccaaggttcgaccccatgttatattagaccgtgatgtaaagttagattgccgagctcgtgacccagagatcgatcgagatcgagatcggccaagaccgagaccaagaaggatagagatcgagcaagatcgagggaagcttcccgagccaaataatagaaagccaaaatatccgcaatcagacgaggatcactgcggaaatctcggcatgtatcaagaagacaccgattaattagataatcatgagatttcttactgtatttagaattgtattaagggtaggactcccctactatataaagtggatctgaatttgtaaaagacattacatttacgcaatacaaagcaatatactacctttctcttaagctctcagtactctgttactttgttcatattttccggtggaatattcgtttggttcgagggcgacctagcttgagggccaaagctatacatttcctttgattttcttttatttctatttatagtcaatttcaatatcaatttacgtattttctcagtttgtaccaagtaaaatcacgtgtccttaaaaccacatataaattccattgttatccgcttttaaggtgacaattggttcaaaaagaagtttactgtagctaccttagaagtctttggctctcacccaacaaaagcaatacaatgcaccccataggcctgcttctacactgctccttaaaatcttctgtgcttcctcattattttatattttgtaatgccatttttttataagtttcgttactatgctcaattaatatatcttggtttcttaggtgattagtttgtacattaaagggattggtaggattattaggaaaaataatatatgtattagctttcgtaaggcatttgcagctaaaagaaattatttttcaagaataacttagagaggtaaatagtagtggaagagtttaactaactgtatataacatatgtttaatctgatttaatatagtaaaaagtgtaataaaaatttagagaaggaagttggttacacttgattattagaaaatcatgtattctttagttgcaattcattaataagatgatgtcgataactccatagctctactctagaatttaaaaagaaaaacaagcaaattcttaaaaaaaccaccaaagatgccacaatttgtttaactaacattgacagtagggttgagatgatttttttgcactggatacaataaattatatacaacaatttaatctataaaaaaaaaagtggacaaatataagagtagacaatatttaatatagtgcttagtacaagtaaattatattcaatatagattttaaattaacaatgttatcacaacttccataccttgtgatcatacacaatttgagaaagattaagtcactgctaaatataatccaagatatatatatatatatatatatatatataatatcatagacacaccctaagttaaaagagaggctcaaaagctgcccgatagttgttgcccacataactgttgggacctcgcttagcgtaaaaattgcacgggacgttctatttggtcgccctcatttaacctatacccattttttaaaaaaagttttaacttgtaccgactttttaaacaacttcagaccctttttcctcctccttctcctccttcattttcttcttcttcttcttcttcttcttcttcttcttcttcttcttcttcttcttcttcttcttcttcttcttcttcttcttcttctttcttctactgttgttggtgttgctatgaaacttcagttcatgggatgattgtcataagtatgtttatcagattatttaaaaataaattataaataattacgtaagttagtagacaataatttgtgaatatttccacgtacatgaagtttaagatcatacttagtgattcttttcatgataattctattcttttcacgtttattgtttccaaaatttatgatttagatactgttgataaactgattattatatagtagtaatacactatgaaagaataaggtgattatttatcgagtatgttagaaagctttttcaaaaacttcagcttatatagtgctgaagttttacaaatgaactaaataacttcagcatcttctactgaagtttttgaaaaagctttatgacaaaactaatgaatccatgacaaaacacttcagcacttatttagtgctgaagtttttacaaatgaactaaatagcttcagcatcttctgttgaagtttttgaaaatgcttaatgacaaaactaatgaatccaggacaaaaaagcttcaacttatttagtgctgaaatttttacaaatgaactaagtaacttcagtatcacaaaacttcagctactagaatgcttaagttcagcaattacaaataaaaatttcagcaaatagagaacaaaacttcagtactagaatgcttaagttcagcaattataaacaaaaacttcaacacacttggttcagcaatttttgctacttcacgcccgtctactagaatgctgaagtttgcgtgattgtctttgctacttcaggcccgtatgataaagttacgcaaaaaagtgggtacgtttgcaattttttttacaaagcaggtataaattaaaacgtgacccaaaaagcgagtatagatgcaaatgcccctcgcttagcccgggaataacctgactagttctaatagattgaatgatgcgctcatatttacgttaaatgaaaaaactaacaaaatcgaaatgaaaaaaactgcttcagtgggtttggttttccttttattgggccaaaccagtccaaatacactcttaatatggtgtgatattatccgcttttggtcaagctcacataatttttttcaaaaggcctcgcaccattaagagacctctacaccttatatacagactctcaatcgttttagctaccaatgtgggattttgttcgtacacccaacaatctccccctcgaactaagttccacgtgaccattgctacatccacatgtcaattttcgagattcactgtatgccacccatattgttagagtattgtggcaacagaagcccgcaactaacttcttattgtgtgtgcaaatcctcgcaccatcactccgccatctccatactcgtcccgctgaacctgaactctaataccaattgttgggctaaactagtccaaatacagtcttaacatagtgtgatattgttcgctttgggccaagctcgcatgtttttttcaaaaggcctcacaccattaagagatccctacactctatatatagactcccaatcttttcagccactaatatgagactttgttcgcacacccaatacctttttttgtcttttcacgatgacaaaaatctaactatgaatttaaagtagacttttatttacacagtatagttgtacctcaatataattgccgataaatatatctttttgtatattaatactagactatataataaatatatcaatgcatattttcatatatttaggtagagactataactatttttagccgatcgccaaatgtgttaaaaggatatcacgatatcactgaactataagctttggccttcgatgattagtccgcattggtttatttctttttgagttttttttataaattttttatttattagtaatacttgatttcaatgtgaaaattgagaaatttatattgaacaatataagtattccgttggaaagaatacttttgccgtagaaaccacaaatgaaaatacaattcttcaatttacaaacaaaaaatgtataaagaaactaaaattttcaagtaaagaaaatagaagccttaaactaatgtcaagattaactaattaatagtattaatttcatctttggataacttagtgagttcatatcttgtgaatctaaagactttcgactcctgagttcttcgttcaaggttgactcaatctttcaaaaaaaaataaaaaaatttataaaatacgttttgtattttaaccaaaagtacattgaaatgtgttgaaattagaagttgtaaatagttgtacatttctgtatttatgtagtattattctagaaggtgattagttaagggagttagtaggtgattagttatgttagttagtataataagaggtgtacagttcatttataactaagcaattaacagaagaaacagtttcttcattttctagtttctttccttctctctaaatctctctatgttccttctcttgcttaagctcatcaatggccgaacctaggactagatttcaatatggtatcagagccatggttcttcgtgactgagcaacgagcatttcactagatcaacttcctacgtttctctcctacttcacctgctctttgatctcttcttcttttcgttttaattttttcctcagatctgtttctttctgccaatttttcgttaaaatatgcatgattcacctcaaatcacagctggatcttcaaatgcaaacaatcaacagattgattgtaatgatccgctatatgttcatcctttagatacaccgggtatgtcacttgttcctcaattgttaattggagctgaaaattactcagaatggaggcaatctatggagatgtcactccttgtgaaaaataaacttggatttgttgatggaacttttactagagagcggtacgagaaaaatgtcttttaattaaggcagcgggatcattgcaatgccatagtgcagtcatggattcaaagttatgtggctaaggaactcagaaacggaattgcgtactcttcaaatgcacagaaggtttggaaaacactaaggattgttttgacaagattaatgctactaaggtatatcatatgaattgggaaatcatctgcctaacacaaggaatttctagtgtatctgtctatttatctaacctcaacgatctctgggatgaatttgagtcaataatacttgaaccatgtgattgtgagaaatttaaaacattgttgagtttcttcgccaacagaagcttatgaagttcttaatgggattaaatgatacttatgcaccttagaggagtcaaatactaatgatacaacgaacaccttcactcgatcaagcatattcaatgattgttcaggaagaaagtcaaaggctgagtagtggatatggtgtacaaagtggaattctaggaagtgaacctatgaatactgaaaacatctcttatgtatcgcaaacaactcaaatgtgaagtttaaaaggaacacaaatctgttttgtgattactgtaaaatgaaagacacactagagaaacttgctataagttggcagggtatccacagggttttaagttcaataacaaaagaataggacctaatgacaactacacacctgcagtacataatgtgagtgtaatggaggagaataaacaaataggaagtgatggaattagtatgataaatggaatgatcaatgcagtagatccaatcttcacacttgagcagtaccaacagatactcagaatgttgagcaaggaaaaaggaccagcagaagaacaaacaccagtagatgtggccaatatggcaggtaattcaatcactgaccaaattaagtggatcattgacactggtgcttcaaatcacatagtttcttccttagatctgttgtcatgtcctaagcttgtttctcattccaagtctacttcaatccatttacctaatggacaaagtactcagatcactcatacagggtcatatgctttgtctaacaatcaaactctacatgatgtgctttatattcctaagttcaagtacaatttactatctgtgtccagatataccaaggagctaaattgtatagtctctttttatcctgatttttgtctctcttaggacctcttcagtggcaaggcgagggggattggtagcttaaaggatggactctacatcctcaatccttcaaagcatgctgctcctctcatttccacatgtatgaccattggccagtctgcttcctcaactatgttgtggcatcaaaggcttggccatgctcctcattcagttcttaagaagatacctacaataaagacattgttgtctaattctagttcttgtaactgtcatatttgttcattagctaaacaaactagattgccatttcctactagtatttcaagattaaaatattcctttgaacttgttcatatggatatgtggggtccttatagagtaaacatttacaatgattatagatatttcctatctcttgttgatgatttttcaagaatgacttggacctttctcttaagactgaaaagtgatgtctatgtgattctatcaaaccaaaggaattgtgcattaaagtagttgtgtctatactccccaacaaaatagagttgtagaaagaaagcacatacacttacttgaagtaagcagagccttgagatttcaagttgcattgcctttaaaactatggggtgaatgtattctagtagccacttatctcagtaataggttgcctagtattgttttgcatggaaagactccttatgagctctttcatggttgctcccctaaactggatcacctaagaacaataagatgcctttgttttgctaccaggcttgactctcatgataaattccaaccaaaatccattcctgctattcttctaggatatgcttctacacagaaaggctataaactgtataaccttaactcttgaaggacctttgtcagtcgagatgttgtctttaaagaaaatttctttcctttcaaatgtccaaaagagaaatttctgtcatctcatcatgattcctcaatagtcatacctgaaactagttctgtgatctttctccttttccatcactagaccatgaaccagattcatctactcatccatcatccacttcactgccttcatctctaattaccaacttgccagtttcactttcagaacctcacagtcctatattgacaaaaacttcattccttaatgtagagtcaatcccatcagacaccttactttattcctctctcaccgatcttgctacctctgctgaacctagcacttcttccttacatgacttacctcctcctaggaagtctaggagaactagcaagcctccaatttggtagactgattatgttcatccacccttaccatctactttttctacttctcatcatgttcaacattttgtttcatatactcacctttctccttctattaaagccttccttacttctttttctattgatgttgaacccttatcttttcatcaagttagtaaagatgatagatggattgaagttatgaaacttgaaattgaagcactagagcagaataacacttggtttgtagttgacttacctgttggtaaaacacctattggatgcaaatgagtgtataaaataaagtataatgcagatggtactatagaaagattcaaggctaaattagtttctaaagactttacacaacaggaggggttagatttccatgatactttctctccagttgctaagacgactactgtgagggctgtcattgccactactactctcaagcactggcctgtctttcaaatagatgttcagaatgcctttttgaatggagatcttgaagaggaagtctacatgactttgccccaaggatttagtagccagggggagcataaggtttgtaggctacttaaatccctatatgggcttaagtaagcttctaaacagtggaatgtgaagctgtctcaagccctgtcttcatatggttttaaacaaatcaagcatgactattctttgtttactagaaatgtggataataagtttgttttgattctaatctatgtagatgatctacttgttacagggaatgatctacaggaaattaaaatgcacaggactctctacatcaacacttcaagacgaaagaacttggagaaatcagatacttcttaggcatagaatttgctaaagcaaaggagggcattcttatgactcaaagaagatatgccttagagatgatttctgatgcaggcttggcaggttctaagcctaaagagacaccaatggagcagaacttgaagctgacaagcactgagtttgatacttgcacagacacaagtaaaggacatgaactgctggaagacaaggggagctatcaaaggctcatagggaagcttttgtatcttacaataacaaggccagatatctcatatgcagtgcagtcactaagccagtttatgcatgcacctaagaagtctcactatgaagcaacacttcatgtagtaaagtgcattaagaagcaaccagggttggggctgttaatgtcaagtgacagtaatgaagaaatagaagtattctgtgattcagattgggcatcatgtcctttgtcaagaaagtctgttaccggataatgtgttaaacttgggatttcaaccatatcatggaaagctaagaagaagcatactgtgtctagaagctcgggtaaagctgaatataagagcatggcacacactgtggctgaacttgtgtggttaaaaggtctattggaagagctgagtgtgaacctaaagctacctatgaagttgttctgtgataataaggtagcattacaaattgctgcaaatcctatgtatcttgaaagaacaaaacacatagaaatatactgccattttatctgagagaaaattccagaagggctaaccaagacttcttacattcccaatcgggagaaaccagctgatgtgctgaccaaagcactaggacatcagcaatatgcaacattaatctccaagttgggaatgaaatacattttttcattctcaacttcgaggggaagtgttgaaattagaagttgtaaatagttgtacatttctgtatttacgtagtactattctagaaagtaattagttaaggaagttagtaggtagttagtataataaggggtgtacagttcatttatagctaagcaattaacagaagaaacggtttcgtcattttccagtttctttccttctctctaactcttgctctctctctctctctctctctctctctctgttccttctcttgctcaagctcataaatggcggaacctaggactagatttcaacaaaatgcaactatctactttacacatcagacacacacacacacactccttcaacagtgatggtcattagaatagttcatttttatcccgcgccagaaaatatttacattcgatagccaaaaaagtgtataaaatttgtataatttttgtatatatatatatatatatatatatactccgtacattttttcggctattattttgagagcggctatagtgccattttccctatattcatggtagcttgaacgactgaatgttcaaagaatacattacatctctgagttattatatatgatttcttccctattatattgctctgaactcttaacaacagaaaagttatgcactatacgtaaaggcggagacataattcgaagtttattagttctgaatctgccatcgaactcataactcgtttagttactggatttgcagttaaatatttatacatatttagtgaattttctaatataaaatagggtctatgcaaaagcaattgggttcgtctgaacccataagccatacactacctccgcccctgtttgtacgtgtacttatactccttcatctacattctcaagtctcagccatttcatatatccgactgatcaggtcgcactgccccagttgattaaaatcatctgtacaccatatgtctcaataatgataccttttacaccctttacataaaaataagataaagacaccatactctgatctatagactcccacatcgggttcctaagggatgtgagctaggtgtgatgaccctctatgtcatcatgccacataggcgccatctgacatatgttaatgctatgtggaagcttacataagaagaaggctagcatttgtgaggagattctagagaggtatggacatttcattaggaagaacctagatccttatggatttactaagaaagtccttggaatcttctaggcttgtagagaattctagaaaaagcctttatcttgtaaatatcaaggacttgtataataattaatatttacacactagctcctaggaaactagtatataaagggggccactcatttgtaattcatcaagcaaacaattcaagttctctctaatacaaagcttcctttaacaattctcttgtgttctttcttccattcttttagcgatcttgagtgtagtaagactgacttgacatagaaagcacgtgagcaagttgtgcaagatcatgagcgagttgtcaagtgccgcacgtgtacttagttaacaactaaggacgtgacaacgtggtatcagaacgaaagtttcaactaagggaatggtgaacaacggagaaactaatgctgtcaacacccaagccaacgtcatccaggatgttgctggcaagagaggccgtagcaaaaagaggaatgccacgaacaagagccaggaggttccacctgaggttgtgtcaaacgaatgacttacatcccaagaaccatctgccactgaggcgagcgaggataaagtggaggtccttccagaggatgtctcgctcgataaagagtgggtgatgaagatgaacgcagggatggacgccgtggagatctttggccaacgtttggggaatgtggaaggcaacttaacattcttgaggggcacactcttgaaaagattgaaagtattccaaatgacttggagggacgtacacaaactgagatggaactaaggcaaaccatcactgccttaacgtgcagactcatggaggttttgagtactatcgatgctatgaaggcaaagatagagtcactcgaggagcatgtcaatgctggcgtgaccgaggtagccagcaatgttgtggtgacgagggaggccaagatcgaggctcccaaacccccggtgttcaaaggtgttcgtgatgcacaataagtggaaaacttcctttggcacttggagaactacttcaggcacgacaaagtgagggacgacgaggccaagatcaatactgcggtattgtacctctcagagactgccatgctatggtggagaaggaagatggccaatgtggataatggtctatgtactattagtacatgggatcagttcaaagcggagttcaagcgacaattctttccaaacaatgtcttgtacgaggcaaggcgcaagcttagggaattgaagcaaatagggagcatacgtaaatatgtcaaggagttcactacccttatgcttcaaatccccaacctgaccaatgatgacttgttgttccacttcatggacatgttgcaaaattgggctaagaaggagttgcaacgccgacaagtcgatgatatagaccaagccatagtggaggccgaatcattgatggatttcacgcatgataaacatgacaaaggcaatggcaaagagtcaaaggttaacaatgtcaaaggtgggggaggccgtggcaaaggcaaggagatacaacaacaatactccaagactcaagatttcaaaaagtcgagtggtcgtcagggctacaccgagaagaagacgcaggtctagaagaagggatgctatatatgcggagggccacatgtcttcaggaattgtcctgaccttaagagccttagtgccatggtacgtgagcggaaagaacagccacaaggagagagtccgggaaccgcacagttgggtatgatcggattatgtggtgctgtcacgaagcaagctatccaacctatcgagaatggcaatcagtacatggatctcaccatcaacgacaagcccgctcgtgcaatggtggatactggagcaactcataatttcgtgacttaggctgccgcaaagagactagaattgaaacttgctccaacaaactctcgcgttaagaccgtgaatgacgagatacagaatgctcgtggggtagctaacagagttggtgtcaaattgggaacttggaaaggtatgacaaactttaccgtaattgttatggatatctttgacatcatactggggcaagagttctttagacattgtcatattttaatcgacccctacctccaatgtctcttggttatggagcgagaaggagcttgcatggtacctacagtgactatgccacacggacagatccaagcaccactctcagctatgcaggttgtcaaggggatcaagaagggggagccgacgttcgtggcaaccattgcaagtctagaggaagacaagaattttcaagagacagtgtcgccttgcatagagaagttgcttgaggagaacaaagatgtcatacccgaggagttacctaagcactttctgcctaggcgagaggtggatcacaagatttagttggagccaggggctaagccacccgtattttccccatatcgtatggcactgcccgagctagaggagctcaagaaataattgaaagagttgctagatgctggtcccattcgcccatcaaaggcacctttcggcgcaccagtattgttacagaagaagaataatggatcattgctcttgtgtatagactatcgagcacttaataaggttacagtgaagaataagtacccgatcccgctcattgatgatttgtttgatagacttgggcaagccaagtactttaccaaggtggatttttgaaagggctactaccaggttcgcattgtggaagaggatgagccaaagacatcatgtgtgacgagatatggagcctttgagtagttggtgatgccctttggcttaaccaatgcaccgaccacattttgcacccttatgaacaagatttttcatccctaccttgatcagttcgtgatagtttaactagatgacatagtcatccacaacaacaccttggaggaacacatggagcacttaaggaaggttttccaagtcttgcaggagaatgagctatacatcacgagagagaagtacgagtttgcacaattgaaggtgcacttcttgggccatgtcattagcaatggcgagctacgcatggacgaggctaaggtacatgctatccaggagtgggaggcacccataaaggtaactgagttgagatccttccttggtcttgttaactactatcgtcagttcatcagtggatacttagcaaaggccgcaccattgactgagttgctaaagaggaacaagccatgggtttggatggagcattgtcaaaaggcatttgaatgccttaaggcagctgtaacaaatgagccagtcttggcattacctaactttgccaagacatttgatgtgcacacagatgccttagacttcgccatttggggtgtcctgatgcaggataagcatctcatagcatttgagagctgcaagttaaatgagacggagcggcgttacacggtgcaagagaatgaaatgactgccattgtgcattgccttcatacatggagacattatctgctcgggttgaggttcgtggtcaagactgataatgtggctactagctactttcagacacagaagaagatcacaccaaagcaggctaggtggtaggatttcttagccgagtttgattatgcgttggagtataagccgggaaaaggtaatgttgtagccgatgccttgagccggaaagacgagcttactgcaatcacttcagcgagatgggacattcgggaggctataaaagaaggcatgcagcataatccagtagccagacagcttatcgagttagctaacaaaggcaagacgagacagttttggatagaagacggcttactacttaccacaggtcggcgggtctacattcctaagtttggaacattagaagacggatcataagagagagtcatgacacaatgtgggttggtcaacccggtcaacgtcgcactagggccttggttgagtcagtctactattggccacgcatgcgagatgacatagagtgttatgtgcagacttgtcttgtctgtcaacaggacaaagttgaacaacaacaacccggaggacttttggagccactactagttgcagagcgtcgatgggaaagcgtgactatggactttatcacttgcctaccgaagtctgacggttatggtactattatggtggtcgtggatagattttccaaatatgccaccttcatgcccgcctcaccgggttgcacagctaaggaagccgccaagttattctttaagaacgtggtaaagtattggggcttaccaaggcatatcatcagtgatcgagacccccgcttcactgggaacttttggagagagttgttcgacatacttggcacagaactgcacctttttactagtttccacccacaaacggatggacaaacggaacgggtcaatgccttactagaatgctacttgaggcattatgtaagcgcgcatcagaaagattgggcaaagctcctagacatcgcccaattctcttataacttgcagtggagtgagtccactgggcggataccatttgagctagccacaggccaataaccacaaactccacattcattaccagtcgcgttcgagggaaagagtttgggggcttatcatatgtccaaaggatgggaggagcagctcgacactgctaagtcctacttggataaggcagctaagaatatgaagaagtttgcagaccataagcggcgtcccacatactatagagttggggacatggtcatggtgaagtttaacccaagacatttcaaggcactatggggcatgcatcagaatctgattcgcaagtatgaagagccatttaagatcgtcgccaaggtaggcaagatctcatacaagcttgacatgtcatcgtatcttaagatctaccctgtcttccatgccagcatgcttaagccatatcatgaagataaaaatgatccgagtaggggccaatcaagtcgagcgccaatgactatcaccacctcgcataatcgggagattgaggctatcatagattaccaggccaggcaaaaacaagggcaaaaagccaccgctatcttcctcgtccattggaaagggcaatcacgaaggaggccacgtgggaacgatatgaagacttgtggcaattcaaagataagatctgagagtttatgcagcagcattgcgccgcggtcatcgtaatattgggtgggggagagtgtgatgaccctccatgtcatcatgccacataggcgccatctggcattattaatgccatgtggtagcctacataagaagaaggctagcatttgtaagaagattctagagaggtatggacatttccttaggaagaacctagatccttatagatttgctaagaaagtccttggaatcttctaggcttgtagaaaattctagagaaaactcttatcttgtaaatatcaaggacttgtataataattaatatttacacactggcccctaagagactagtatataaaggggaccacttatttgtaatttatcaaacaaacaattcaagttctctctaatacaaagcttcctttaacaattctcttgtgttctttcttccattcttttagcgatcttgagtgtagtaagactgacttgacatagcaagaacgtgagcaagttgtgcaagatcgtgagcgaattatcaagtgccgcacgtatacttagttaacaactaaggacgtgacataggtctccttaatgcggcttggataattctcacctcttgaccagttagcttttttttggtcttgttgatcagttaacttttggaattgtctttgcttgattccttttggaggagatttacttcctttccttaattttcactttatcagcaaatccattaatcaaattattccatacatcaaacttccatcaatcttttaatttcatgggtgcatgtaaagtttctttcctttatttaaaagctattatctgcattttgaaatggggttacctatatccctattacgcttaatatgtcaatcctttgttatattgttcatggtgaagatttaagagtgactcattaggttttaagagtgttttttataataactttatattgtttagtaaatagttttttaatactgtaaactattataaatagtgcaatacaaacttaatttcgttttatatgttattgtttaattttggtacactaattattctcactggagattttatcactttttttaaaagtagcatgcatgtttaaaattaaactattctacttagaggattttaattcataatcaagcgtaaccctgaaatttaatatctcattttctccgcttcccccatccaaaagaaaaggtaaaaatttaaaaatacgcgttcaaaaataaaaatcaaaatcaagtataattaatccatgaaagcgttcatgcatatgagctaggcataacaatattatcgttattaatagcaagagaacaatattccatagtagacgacaaaaacattatatgtctctcaccactgtaaagttatattcttgtccacatgtgaccaagttgacaattccggaaatccaataaaccacagcactacaggctccgcttgcagctgttttgtaaatctgcttgtttcagtttgttaatgtacgtactatactataaaaaagcaatattaatacaatgaatgtacagtacccttatattataacgcactaaaggacattgaaacatcatccaagaccatgcaggaatctagctaatatctgtagccagcaattttcaagaatttcaactctttcgtaagcaacacaccgtttacacatgctcctttttctatttttaccactgttcattttgttaattccatttattctttttcttattggagtatcttgattagtatataccattagaattaaacgtgagagtttttttttcgtgtgtgtgttttgttttcttttggtagggtagggcttgtacgcgtgggttgctgagtcctctttatttttgtagttactccactgttgggcaaagtacagcctaagagtacagccatgagcctatataaattctttgtaatgtgaaggaagcaggagaatattatataaagtactcttgctaaggtggtgagaaaataatagtgaggaagaaggaaaacagaagtattcagcatcaaattaaagcactacagcattaagcaacatcaacgtcttgataaattctgctaaagatgattcttgagaaacagtgacaaatacttatgcatggtacgtttgcatggaattggcatgtttttggtatctttagaggattataaaacctgcatttacgacttaatttccacttctagctatcattttatatataattccctaatctcgatcttgccttttccttttccttttcctctgaggttgtagtgtatggatgctttcgaataaaatgtcgacgttcttctcgcacgtttatacctaattaagtttactgtgtttctacacaatttatatcattgaacttgaagtttagctgccaaagcttaagcagagcattgacaaattttgtacttcggtaaaactttgtatcgaaaatgaatccttgttttttgagttaattaatttcaagtcttatcttgaaaccgttctttcatttaatttgctgtatataagatatacattctgttggatataattgagttcttttagtttctatcattttaaactttttacttttaacttttttgttgactactttcactttctctttcttatttttgacttgattgccaattacacatgtttattcggttattctttagcatttacatatacattctgttttccaaaaatgcaaattaatcatgaatttctgtcaatttatctttgattatgtcaagtctagcaattctaaaaggtaacaatattaataatttccatcgcatgagaatttatctatggcgctcctactttgtgatttctaataattttgaagtagttaaactgatttttatttgttggcgttgctactgggatacagcaggtgataaattttgagatgtttgtcttattaatttatttattggaagaaactctgctttaataggaattgattctcatatatatgtgagaataattcatagcttgaagtatctgttgtaagttaatttttatagctggtcaaggaaataattcttttttaatcctttttgatctttatatatgttcaaaacttttatataatcaagagagaagagatactaaatataatatctgtgccaatgtgagaacaggaaaagattttccacttgaaaaaatacagaattttaagtaggcgtttgaagataagaattgtaatttttgaaaaaaaatactcatttagatttaaattgaaaaatggtatttcaaattatgtttgaacatgtatttccctttaaacataaatattgtagttttgttagtgaggaaaaaagtattttggaacattttgaaaaagtgttcaaaaccactttttgatttttgaaaaacttattttcgaaaaaatttcaaaaacttgtaaaatttcatggacaaatacatttttaaaaaaaaattctgaaaaaaagaaatttcttttttcataatatttatttcatattcagttacatatattaattttttaaaaaatattaatataaatagatttaaaattatgctatttactgtgatttatactctagttgataagagaccaacacgaacacaacttttatttttcttcaaaatgtatttattagaggaaaaatgctactatatagccgctttcaataaatagccgaaaaaatatatttttttgtatatcttttgtatatatgtacattctgtatgttatatacaaaattatacaaattttatatacttttttgttatcaaatataaatagtttctggcacgagctaaaaaaagccctattctatatgttaattagatgataaatgcttttaacttgtgaatcacattgtatagttaactgttcattcaggggaagttctttttaaagcagttgaaggctattttgtattgtttttcttatccaattgctcctagagcgagctaactctaaaaaattcgtccaaccgttcaaatttcaggctgcaatttgctcgcataaagtcaatttaaataaatataaaattaaaatttaattattcaaccatgaataaatgcaaacaaatatgtgtatagaatatatggtatatatatatgtgagcatgtgtggctctgtgtatgtgttttagaattcttgtgtagagctgatgaaaataagtggtattttaatgtttcaacattatcttatattaggacacgtagaatttggcattttcaggtgaaaagtggaagcatctgttttggattcaagtgcaaatctccactgtctccagctcactcgaggaaaaacttgtctacaacatatccattgcatgcatgctgctctcaattgttatttatttactctctgaagtttccaaatatttttgttttatttataaaaagaatttttaacggttttagcttttaagaactttctttgcgttgaaaatattcctatttcaatttaaaccgtatcttgtgataaggagcaggaggattgtctggcatacaactgtttttaatgatttttctagaaacattttcaaatcctgctcttttttttttttttttttttttttttttttttttctctttcctctctatcatcttctcgtcgttcctaattaaaacaaaaatttccttttaatttcatacaaattaacaaatatggtattgatgaaattttgatgtataaagtgggatcagaacaagttgaaagcatttattattaagcaatttaatttgatatgatgtaaatattttgagatgtaatgatagttgtaatgattaacaatatgttcaatagtttttttttccttaaacagagaatcaaattaattggaaaacagtgaccagaagacagtgcgctggaagttgaccacttctgccccttaggaacttggtgatttttttttatcttttagaaatgttttctaaaattgtttattaggtggtgtttgctgcattaattgaaaattaattttttcgacaaaataaatatatttgaatttgatcttcgcaaacaatcaaaaactgcgccaaaatctataaaaacgtgagccgtcagatagacacgtggctaactaaaggaccagaattgaaaggcatacggtaaacccgcggagcaggaaactaatccacctctctccgaatttccgaagcccccttcgctgaaaattgaaaatcagaaaaaagtaaaattggaggagaggcttagcggtagggacagagaagatcagagacgtatgaaaaaggcagagagttacggctaattttttgaatcaattttcacttcccttcgtaagtgtttttcccgcgttttttttttgtgcctcgaatcggttgaaattttctgtatttttaatgatttttttgtgtattaaattctttactaattatagttagattcatgtatatctgcaagtttatttgtttctattcgtatatcttgagattatatgcaaatcaaacataagagttaaccatcagatcgagaagaaatcgagcaatcgttttagcaacttcaaatagctgatttttatttgtttaactacgttataatactgaattagcgagggaattcgatttcataatttttaaatgcttaaaattgaactagaatctgaatttctaaaaattggcgtcaacagctgaaaaaattagaaatcctatacctttcttccctgaggaaaatgaatgattaatcacttgaaatttgattaccacgtcttgttccttgaataatccgatgttttttggcctttaatggttttccattatcctctttgagaaattagtaaaaccggacagaaaaggatagttgagattataatttggtgttgactagatataactcgatagtcgactaattgcaccaaaaagggaggaatttgatttcactgcctatctgaatgggtaaaaacagaaattcatgctatattttaaatcaattgtcaaggtaaaattttctcttgagaaaaataggggaaagatgacggttttgttacgagatctgaggatatttcatgcttatttctaaagagataagcttgcactctatggaggaaatgataagttatcagcttgaattatggactaacgatcactgaatcctatatgtcatgtggtgatataatgaattaattggaagtaaatagaaacaattaagataaacaaactgcagatgttcatttagagaaacattaacaacggattctgatgatgcatggagataaccttttaggaggtggaaagcatcgcaagtttgccatgttatctgattaacaaaggtgatgattgcagctatttagtgcaataggaaatcaaatctacgtataataaccaatttagttaaacaaattcagatgtattcacctgaaaatttattccttgattttgcaataatttcaagttagtctaaaggaggtttgaaacgagtggataatgttggagaaaaaacagcttggatgtctgaacattagcgaggtctaccctgataaacaataatatatggtagttagcattgggtatcatatctgagcattacctgagtcatggaacttgagtttgaagccatgtgtcccagttagtttaccatggtaacttctcaacccaaaaccagaaagaataaaaaaatgataatattaatatgagagcaggtgttgtgctggctatttctgcgctatgtttacagatagtattgttggaaggtcattttggccttatatggttgtggttgtaaatcaatataatgttctttgcatgtctaattagtttaaggtcttagctaaacattctgtgtcaatttaccatcaaaatgttaccttctgtgagagcacatgctcctataagcgcgtctagctgtctaccagtgatgaatgtggcttgagttctgaacttatggtatgacctacatttgccttaaactggattagatgtgaatattagaactcttttccaatttggaagttatttgaattttccagttgttggcttctaaccgaggtatatcattggatttagtgaagatcctgatgatgcatcttaattttgttggtggtgcaaacattatggatccttaaatcataagtgaccttgagggaaccctaattaagatggaatgactggtaaagtctgttccaaatttatttttcacagtgaggcctcctagcatgaagaaagaagagcccttatttttctttttcaaaaaaaaaagaaaaaaaagttgaagaaagaagaacctctcaccagcgttgtttgaacaaagtacataggaaagatggctactggttataacctttgcactttaacaagtgcaaacagattgtatgacatggagtgtgaagactaaaaatgagaattcgtgtatgccctgctctgctgtccatggactattatcgtcatggatttatttttaatttgtctatgtactttgcttccacaatatcttctccagaaatgaagtcaaggaaatcactgaagcctccttctttgtaggacaagatatgttgttcatcgacaagtgctggtgcaggtctaacttttttacctagagctagactaagaaggctggcaatggataggcgctttttctctgagttaactgttgctcggtggagaacacctttgtatcggccattgctcaatacttccatgtgatctcccagctgaacaatgagggctccttcaatgacaggaactgaatgccactttccatcatgatccatgatttgcaagccctgatgattttgaagaatgatcgttagcaaagcataatctgtgtgtggtggcaagcctagtgtaagatctggctcaggacatgctggatagcaattaatggccatgacctgggagccttctgcaatgtcttcatgtaagtaactagggtttagtcctaagctctcaaatatcactcccatgagttcttcttgcaacttttgtgctgcgatcgtgtaatttcccattttctccctgcatgataaactgctttaggtacctatagttttattattcttgaacagtgagaaaatatatctatcagaaatcatttcagataagggtgcaaaacttacttgtaacatgtgggatttgatggccacaaatcaatccaatttgagagtggattagcatagtgcttgaggaagtctctccaaaaggatactttgtctttgacatcatttaggctggtattataccttacgggatcatgaacatttgaagacaagagatgcattttcttttcatttggtaaatcgaagaactcagtcgcagcttctaaggcatctttcatgactgacaatgggattccatggttgactacctgcagagtcatttattgcatgcatgctgttattttacgtccaggttgaattagcgaagcacgtcttattctctttcctgctaaaccgctatgtatctaaaatctaggacatctcttttaactgatcaactgaaaataaagggacgagaggaggaggaggaggaggaggagatatgtctagaaaccaaatgcaccatgtatgctgcatgaagtttctttttcttgatttccaaatgcttttgtctctctgtggggaatctgacaacatcttttatttacgtggtgtgtgtatattgttcttccttaaatcatatcagcacgaaggaactttacatgtaacaaaataggataaaaaactatatcattttagtacatgattgcaggtgacatgacacgagagaagtacctggaagaaacctagttccttgcaagccaggtgtacttcctcgattatccgaggccgatgaagagggtgtcgcagaaaggatagatctacaattggcaggcatgtgttagaccgggttccatcggggcgtaaggatggcggaagaatgtaacgtttgggaactttggttagaccgtcttcagtaagtgtcatggcactagtaaatgaatcatttggtgaagctgagctcttttccatttttcctcatttttttccttgtttcaaatatggcttaactccttatttataagcagaaaatatgaagatttaattatatatatatttaaaatcatttatccggttatgcaatgaatatgtgtagtatgtgatgataccatgactataagcgatgaaaagtgtatgcaatgaattattattgtatgatattgttatttttgaaggccgagaaatgtcagatgacggtaattgttggtttcacaagttgatccagaatgtggggaaaagaaatccagaatgtaattgaatacagagattgtgttagattcaggtggctgtagcccacgcgccatgagggagaatagttttccaaatatttaaacgtggggtacgtaaggttgccatttgcttttgttgaggacgtaagcagtaagcgcgctctctggagtttgaactcattcaattcgttgcattgcgaataggggtgtttataaaaatccgaactaaatcgaaaatcaaatctaaatcgatcaaaaaaatcgatacttttttgtttggtttggtattggttttgaaatttaaaaatcgatcaaatttggtttggttttggttttaattaaaaaaaactgaaccaaaccgaatataggagtagttattttaaatttattattgcacctatatatgtgtacttttatacaaagttttaaaatttttatagtaaatattaatcgtttgcacttttagtacagttctttacctttacattctagtttaattggtggttttcttttgttaagtgtaagaatctatttcatgttaaaaaaaaatatttttaattgggtccttaaattattcatcactatttgattcaattatcatcaatatatcttggtaaataatagatttctcaaagggcaattgatttgatagtattacgttgaaaatatggtcgccgaaatgtgtgtttggtagtgtatgtcttatatttaagaaaaaaccgacaaataaccgaaaaaatcgaaaaatcaacataaaccgaatcgagaaaaaaccgacttaattggtttggtttggttctaatatttgaaaaaccgacttaattggtttggtttgattctaatatttgaaaaaccgacttaattggtttggtttagttctaatatttgaaaaaccgacttacttggtttggtttctttttagggaaaaaccgattcaaatcgaaccatgaacaccccaaattgcgagtaaggttgctcatgtttatatttgcttcgctatgtttgtttactaaatttataaatcaaattaaccaaatatagaaatagtcgtttccttttatttatttattttggcactcatctttcttcttgtattcgaacatcttttggactaggcttttacatggaggtatataaagggaactattcttagatatacataacaggactaggggtgtataaggaaaccgtaccatatcgataatccgaatcaaatcggaaaaaaaaaattacgattatgatttggtctaaattggtttggtgttgggaaaaaaatctaattataattgatttggtttggtttagttttaactaaaaaaaatcaaatcgaaatcaaaccaacccgacattatatttatacatataaatattttttgtaagagaatttattaatattttttaaaatttttcacaactttattattaaacatattatttcaagtttggacttaatattcttgaatggtccaataaattttatagcctataatgatggtaattcaaataaacttcaaatcaatactaatactaataagggaaattcaatttaacactagaaatgctattgttggatatatatttttttagttttgcattggtttataatgaagctcagaccctacttgtgggactccactaggttgttgttgttgttgttgttattggtttataataaaaatgcataacttagtttatctttttctttagtgcttagttgtgtaattaattagtacttattagttgtacttattttaacatgacctatatagtatttttaaaccaaaactacagctatcgtttgctaaatggtttataaataccctgcgtccatctatccgtccaaaaaaacatacgacattaattctattaacaaaaatacccccgcgactaacgacagagttggtgggtctttcatttaatgacgtgacgatttttaactgggccacgtgacaatctttgactggaacaaaaaatgaatattatttcaaccaatttaccttatccgacccatttacaaaaatgggtggtatgtatcatacccgctcccactaatctgacctcctctttcttcttctccaatcatacaccccatatttggataaattacataacagaaatggaccaaatttacactagtaaatttcagtttcagcttcctgcaacggagccacaacagatttcgaaatcataatcgtaccactgtcaacaggctcatctttcgcaccttcatcttctggattcacatttacagctctagaaccattcaccaccacaagcttaacctcaaacacctgcgtaaaaagtttgttcacctgcacaggtgttgctgcctcaaacacttcctttactttatttttgattgagtgaaacttcgactacgtaatcgctatcaaatctgactgtggaggtgttctagtagtaatcaactgttaaaatcaatcgctcgatgagttgggactccttatggttcgagaaacaagaagtggcagcgatgacgatgattataccattgataaaaacaaagagatacagaagtttaagccaagctataacggcactccaaatggttgggaattcgttaaaaacccgtggaattgacgcttttaataccattgctaaggaaactgccccaattgatattagcacaaccttcagtgatagaattaaacttttcgtcgacggtgccattttaatttctccgataactttaacgaaattgtttatttttccggctagtgttttgaatttttcagtgatcgatttaattcaactgtaaagtaatttaataaaggcacaatgtttacacataatatcaagctttgaaggaaaatttttttttagggcaaaagctcatatgagcttttcagatgaccaagatcctaatttggagaagaagactgaaaatcggtggggttaatgtagttttatgacccatgtaacaaacttagggtcggattaggtaagtgggtcgaaataagttattttggcccgaaactgccacgtggtccaataaaaaattgccatgtcattaaattaaaggcccacatgttcttccgttaaacgtgggggtaattttataataaaattaacgtcgtgtgcttttgataagggtagtttaggcccttttccgtatttttttttatgaattttattatctttggtattgaatattttttgtacaatgttatgactcatctcatatttgtcacgaccccaagtccactagtcgtgatggaacctaactcaacccgctaggtaagccaactaatatttatccaattccaataatattaacaagacaattaaacaaaagtaagttattgaatcttatacatttcccaaggactggtagtacaaatcatgagcatctaataatagagtttacaaaggtgataggaagtaaatacatcttctgtttgaaaagtacataaacagagttctatgaatcttctgtgagcacgtgatttttgccctatatatgaataattcccaaaatcccaaacaaaataatttttcttttgtttttacaatttttgtgcgttttggtgtcatcttctgataattgttgcattttatttgtgcgcgttaatttttataaaatacaaaaatacgcatttttctgcacttaggatttaattttatactttagtattaattagggattaacctgtcgcaaatagttatcaatttaattttaggcgttaattggttgtagcttaattgttagtttaatttcccatctttggaaaaaatcagaaaaaataaatacaaaaatacaagattgcaaaatgcaaaatggaaaattattgttaaaagaatatagagggggtcttgtttgagacccgaaatttgggccaaatgcaccaaatatttcaggcccaaacgcatcaaacactttaaaatgagtccagcccaagtccctacccggtctgcccccccctttaaatgaaacgacgtcgtttcagggcccttggatcaggaccgttggatctcatcaatccaacagtccggaactaacgaggtttccagtatataagggtccaaactgttccccccacccccatttccatcgtcttcttcacccttacccttctccccaaaccctaatccacgccgccctaaaattccttgccggcggtgaacgcgaactacaccgttcaccctggaattaacaccatgggttcccctcaccctcttcttgctattacacccgatggtttgcctcgaataaggccggaactcttcgaatcttgatttgaagttttccggccaggtgacaatttgtccgaatcagcccaaaatcataccctacaacccccagtccttccccaacactaatctgtggttgttttctttcaaatcaccttgaaacgacccaaatcttagatctaagaattgctgaccaaaccctaaaatcaaatccttttgatttcgaaccgtagcacccttaaccatgtgttctcgtgtaagaacacatggttagggatgttacgcgtcaaaaatctgaaagggttcagatgtttacgactggccggaaccccttttgcctttgtgagtttttcttttctttttttactgtttattttgctagcatgattaaaatgttatttgcagtcgttgtttcattattgttctgttaatattatggtttaattgtgttagtttaggtcatgttaattactgttaattctgagattgttagttggttgaatgattataagttcatggtttaataattagttttaagttcatttaatgttaatcgtggtagcttaagctcagtttaatttcattttagcttatttgagttggttaattgaacagaattgggtcagtcagtctgattagttggtttctgattgctagctaattaattttagttagtttctgattgctagttaattagtttttagttagtttcagattaggttagggtattgggtatagttgttaaggataaaggtaggttcagtaattctgaaaggctttcaggggtaagctgggtatggaaaagggcagttctgataggaatagtaatatcaaggtatagggaagggtagtatgggtattgtatgggtagaggaatgctttagggccttctagaatgggtttcaagtgtaaaatttaataagtgtactgcagttacttgtttagcaagatagaaatagagggaccaaagtaaaaataaggagggactaattagaaaatcagaacttagtttattctctttgggtttgcctataaaagggcataagatgccttgggaaagggggcgactctcaatcttctgccttgagccttaaaattttaatttgagctttcatttttattctgttagcatttcaattctgagggtattcagaaaataaaaacatcaaaatatggaaatctgaaacagtttcagaatccccttactagttttggacttcagttgtgagggacaggggtatgttagactgatctgtgggaattggcttacatttctgattttcgaagtagtctgtctgtgtttctgtggcatcacattgttgggtttgttgttgttgctgttcaaagtacctgactcttcaccttttctctatttcacattccaatttccaggtacatttccctgaatctcactgatgtatgtttgttgaagtgaattgaagtgttccaaggcctgttattcaactgaaagtagcctgtatctttaatgatagtagtagtgtagtctcttgttatgtaattggcagaatgtgtataattaaacttgttcagtagggtagattacatgttgaatgatgcatagtttagaactgttgaattggacatttgaataagctttgagcatgggcctgggctgatctgtaattcgtgtgaattcccttagtcatcagaaacaattagacctgtgtacatgacatgaaattcatgagcaagtttgatgacatttagcttagtcattggtattttgtcattatagtgtaatagaaggtttgcttttgttttaagattctgaaatcgtttggaagatcataattatggtaagtaaattggtatagaaatcagttggaaatcatgaagcaaactcattcataattgacttaattcattaaaaacagcaggtcgtgataggcaatgtggaggatagatcatttatggaatctgagaattcacgttttcagtataaggattcattgttacaataagaataaacctatcttcattgggccgctcggatcacgctaaggccacgggcaggcccaattctcctttaaatttggtccttattttatttcattacaatccatttccaaattaactagtcttttagaggcatacaaataagtagagaatcgtagctattttggaattactgctagccttgccggaataaatcacgtgcgcaaactgtcaacagtgggctactaaaatgattagaaattgggatggccatttagcaaattccatggtcctctttaaaatcatgttacattagaatttttaagcacgacctccttaagaattaccttcctaaactcgggtgcgcattgatgcgacccaaatccaaatctcgatgaagccgaaaggtgtcgataatcgcgggtgcattgattgcaacgtggttcgaaacacgttttcatgacatcgtaattcttataaataaataatgatagaaaagaggttttctgcaaattgagacgggccttaccgcacaaaataaataaatgtggggcccttagtaaataattatcgaaatatttagaacttggaaaggttgtttagtgaatttcaccgccttccccaaaataacaatacgttagtatctttagacacgatttaattgttaatttcttaaaattagagtgcgcattgatgtgactcaaatccaaatctcgacgaagtcgaaatgtgttgataactacgggtgcattgattgcgacgtggtacgaaacgcgtcttcacgacgtcgcaattcttctaaaatataattataataaaagtggttcaaaactagtaaaaggcacacaagctagcatgtattaaaatcagacaaaatcaaatacaacagttaagcgaccgtgctagaaccacggaacccgggaatgcctaacaccttctcctgggttaacagaattccttattctgatttctggttcgcggactgttaacagagtcataatttcctcggttcgggattcaaccggtgacttgggacaccattaatctctcaagtggagactctgaataattaataattcaattctgttccgattgtcctttaaatggaaaaactcctttacgccctttgcggggtgtaggtagtgaaaaaggaggtgtggcagctctggcgactctgatggggaatcgaacccagaatctctggttcagggttcagaattcgagcttagaaaaattgttgtatttaatcatatctgattttcctacatgttttatgctaattgtgctaaatgttaccgctttgatattgtctgaactgtacataaattgtgctgacacccttctctcttcacctccggggatgtgcttactggttgagactccccattctgttagtgtcataccctgaaataagaaagaggtcggacaagttacgaagccggatggccttttggttcccggtaagttgccccctcctcgactcgagttgtccgctcgggtacacagtctagtacactgacccaggttttgaatatagaataacgtgacttcatgccggatccctagtaggaacgcttatttgcatcacgttgcatttgacttaggggactcaacacaggggttgggtccgtctaggactagcaaccggaaatgaaaagaccattctgatgcatcctaattgctctgtacatatatttgtttcgaacttgcatgttgaccggtttctgaatctcaggaatgtcggaaagttgaaaaaaaaaagagaaaaaaaatatcagttagggagttaattgattattttagaaaaaaatcaatgaccaaacactggcgaaactctgccgaaattttgagaaagaaaaaaaaaaggaaaatgttttattttgttttactaaaaaaatagaaaaaaaaagtcttttattttagtttggaaaaatagattgttttattgtttgttgaaaatggaaaaaatcgttattttgtcttgttttcaaaaatagaaaaggaaaatagtttgtcttgccagggaaaaataaaaatggaaaaaaagtcatgttttaaaatagttcggttaatttgcccgaactacgcatggtttgattctcacagggtgtgagatacgtaggcaaccctcatcgggtccaacctcccctttgcaaaaaataaccaaaaatatcaaaattttaatttttgtcataaataaaccaggtgatgctgttttattcaaaaatagccgaatgttcccaaatggggcgccgggaaggctgactttgcataaacagccacctctagtcgtattttgattttttttttcacagccttaaaagtttcgccctcgaggcattgaaaggtcgtgtcgcaatatcgggtcctttatcttaaaaaaaaattagaattgagaatcgagttcttcatttgaaaatataagggtaattttgagtcgataatatagatagttttttttatttggagttaaataaaagttttcttttgcttaaacgctttaataaatgtgcaggatgagcacgatggtaaatgggcctttttcaataatgaccaaaatcccttttgagctgcaattgtggtggaatgatttgggcaaagaagggcaagacgaagtgagaaaatatttgaaagaccttccggatttattagacattcagcctcggggggatatcatcagggcattggtcgcccattgggattcggcacataatgtgtttcatttttcagactttgaactcaccccaacattggaagaaatagcggggtacattgggagtgaccaagctccattgagattcaagtacttgattgctcctagggccattactatacaccgattcctggattccttgaaaataccccggacagttcatcacccagattttgcaaagggtttcttcagtttccgctttgtgtatgatagatatggccatgtgggcgggttcaataatccagaatttaagctttgcagcagaaatagccgacaaaaatgggaggaacacaagcgagtggcatttatggtagcttttttgggtctcgtaatattcccaaggaaagatggtaatattgatttgaaagtagcaagcgtcgtcagtactttgcaaaccatggggaaaagcactttagcacctatgattgtggctgatatctttagggcactcactgcgtgcaaagctgggggcaaatttttttagggatgtaacttatcgttacaaatgtggatgattgagcatttgtgcccgcgctctcggttattgagttatggttcggctgagaaaacttgtataggggaattttgtacgagaatcaaaggggctagtctacctgaaggagtcacggcttaggcattattatttcggaacctcaaggctagctagatatagtgggtgcttggatggttgtctgtcgaggaagtcatatatatgccagcagcccgaccgcattttttgttaatgggactcaaaagtatacaaccttatgcaccatatcgggttctgaggcaactcggtagatatcaagtaataccgagagatgaagatttgagtacccaagtggtcgaaattagtcctgacggtcgattccccgaggaagaggttcgtcaaatttggagtgagtgtcaatatctaatggcaaacacttgtgtgtctgatagggtcaaaggggaaattgctccagggtatcacgaatggttcagaggtaacgtggcatatgggagaccagctaaaagacctcatctcgaagatttcgccaagtcgtcccaagagcagtgggattggttagcaaaggaagaaagctatcgagttgagattggtaaattaaagcaacaagtcgagagtctgaaattcgagaacagtgtacatgttgtcgcggatcaaggtgaaaagaatagactagccaaagaaaatgaagcacttagggcccagatccgacagttgaagataaccatcgataagcaaccgaggagccggtccgatgaacaattggtaaaaagattggaaagcgaagtcagagaatggcgggatgagttaggaaaagctaaaagcgtcatggcagaacttaaagcacagtgggcgacaagaaccgaagagcgtcgccaatacttgaatcggttgaaaagggaccatgagaaaattgttgccaatttaaagagaaaagtggttgcccttgagggtaaagcagttttaaaaacacaaatggctgaaatgcatcgggcattgtcgcagggacacccggcaccactatatcctgccaacccatcttacatcccacccatggctcaagctcaggagcctaccactccccacgcatcttcagctttcccttatcaggcccagggttatggtgctacgtcatacgctcccccagctccaccctctaaacagaaccctccaccacccatggttcccgtctttgtggcacctcccccagctccactacatagatcatctagtgagccgctattccaagctcacgatacccaatattaccctcccgaacccactttcaaagcgcctgagccatatacctactctccctattttgaaatcccgggagaagttgagaaaccggttaagaatgcagagcaagaggaggtgattcgtaaagtcaaaagcctggagcaatccttcaggaacatgcatggttttggaaaccaagttagtgtcgcatacaaagatttgttcccttttcctgatgtacagttgcctgcagggtttaaaatggcgaagtttgacttgtatgaggggcacggtgacctagtagcccatctgcgtggtttctgtagcaaaatgagaggtgccgggggaaaggatgagttattgatagcatatttcgggcaaagcctgagcgggtcagcgctagaatggtacacgaggcaagaccccggccgatggtatacatgggatgatttggcccaggcattcattggtcattttcaatataacctcgagatagtccctgatcgtctgtcattgttgaaactagaaaagaagcctggagaaagttttagagggtttggttttcgctggagggaacaagctgcaagggttgatcctcccatgagggagagtgagatggtagattacttcttgcaaacattggaacctacctattttggtcatctagtgacatctgtcggaaagtcgtttaatgaagtggtaaagatgggagccatgattgaggaagggttgaaatctaacaagatcttgagctactcggcgttgaaagcaaccacccaggccatccaaagcggtactggtggtgtgctggggaagaagaagaaagaagaagttgctacagttgaagctaatgcttggtccaggcacaataaccctccactctactacaaccaacccagaccccaccacccaaattaccaatataccacatatggcccaccgcaatactattattcaccaccagaaccacacttttctattcaccacgcccagacctacactcagcccccggtgcactcgcaatggcgtgcaccgaacccccaaaacacacatccacccccacaaagcacttatccaccgcccagggcaaacagaccaggaaccagcttccgcccaaaccaagcttttagaagtgagaaagccccaagcagaaaaacatttactccgctgggagaatcttacaactgtcctcttccacagattgaaacagttggggatgttgaccccaattgaatccaaaacaccaaacccccttcccagaaacctggaccattctgttagctgcgagtactgctcagggatgccggggcacgatactgaaaaatgctggaaattgaaaaacgcaatacaagagctcattgataatcgccgtattgaggtacaggctccagaggccccaaacatcaatcaaaatccgttaccagcgcattatgaggccaacatgatcgaactgatacataagggggcagagcctaagaaaccttcgtaggtagttatggtgattcgttctacggaagccaaagaaaagacagtgagtgcaaggccagtggttcagttaaaagcgataaaatacaagctagtgttagtaatgggaaaggggccgttggtggtcaagaaaaagcaggagccggtcatgatagtggtaccagggtcagtatcagcgcccgtggtggttgtgaagggagcttatgtagaaccggttgtcataaaaccggtagtccagttacccatggttgatagcaaagccgtaccgtggaaatatgacaaggtagtggtgacatacaaaggaaaggaaattgaggaagagagctgtgaaacacaaggactaacccggttgggacgttgtttcgctcccgaagagttgagaaaggctaagggcacaaaagataatccaatgccagttaaaaagtctgtaacagaagaagaggcagaagagtttctgaaaaggatgaaagtacaagattattccattgttgaacaactgagaaaaacaccagcccaaatctcgttgttgtcgttattaattcattctgatgagcactgccgagctttaatgaagatattgaatgaggctcatgtgcctgacaaaatttcagtgaaccatttagagacaatggccaacaagatctttgaagtgaacagggtagcattttctgatgatgaattgcctatggaaggcacagaacacaacaaggctctgtatttgatggtcaaatgtgaaggttcaatggttactcggacactaatcgataacgggtcgaacgctaatatttgcacgttatccacattgaacaagttaaagattgatgaggatagaatccgaaaaaatagcatttgtgttcgagggttcgacggaggaggaacaaacaccgtaggggacattgtacttgagttgactattggcccaatcgagttcacaatggaatttcaggtgttggatgctgcagtgtcctataatctgttgttgggtcgaccatggattcatgcggccaaagccgtgccctctacgctgcaccaaatggtcaaattcgagtgggacagacaagaaattgtgttacatggggaagatccctcatgcgccatgaatgatgcccttgtaccctttatagagactgaagatgatatgggaccatgggtttatcaggtctttgacatagttccggtgagcagggtgcccgagggtaaaagcatgccatgtcccaggatgccagctgcgaccgtcatggtagtgtcagaaatgctgaataacgggttcgtgcccgggaaaggtttaggggtcgagcttcagggcattactcaacctgtgtctttgcccaaatatctggacaccttcgggttagggttcaagccaacagcggcagatgtcagaagggcccgtaaattgaagaagaaagcttgggtgcttcctaaaccaattcctcgattgtctaggtccttcgtcaggccgggtatcaagaaacagttattggcaaaggtgttaggttcgttgattggggcagaggggaatttggataaagtgttcgagagagtatttgctgaagtaaacatggttgaggctggagaagggtcaagcggagcagacatacagtacatcggaccacatgtcaacatcaacaattgggaagctactcctcttccagtccggagggagtcgtggtagtgggttttgtttttcctttttgtcacctggattattccagggtctgtaatccagttgctatgttccgtccgtttggatgagttaaaaccttgttgtctttacatttaatgaaatgcaattttctttgtccctaattctctttccattttcttttctttcctttctttgtacagttctttttatgctgatatcaatgacatgacatgcatgaggaaccttcggcctagtgttaaaagccaatctagctcggaagtagtaatacaagagaacgagtgtgatgatggggtggattgtaacaatgatgaagcttatgaggaaattagtaaagaattaagtcactttgaagaaaaacccaaacctaacctaaatgacacaagcagttaatctagggggccaagacaatgtacgggaaactaaaataagtgttcatctggagccacaactcaaggaggagataattaaagtattgcatgagtacaaagatgtttttgcatggtcatatgatgatatgccgggtctaagcaccgattttgtggttcataaattgcccactgatctagcactcctccatgtcaagcagaagttgagaaagttcaaaacagacataagtgtgaagatcaaagaagagattaccaagcagtttgaggaaagggtcattcaggttacacggtacctcacttggttagccaatgtcgtgcctgtgccaaagaaagatggcaagaccagggtgtgcgtcgattatcgagaccttaacaaggcaagcccaaaagataatttcccactgcccaacatccatatactgatcgaaaattgtgccaaacatgatattggctcttttgtggattgttatgcgggttatcatcagattctaatggacgaggaagatgcagaaaagacggcattcatcacgccgtggggaacgtattgttatcgggtcatgccgtttggtttgaaaaatgctggggaaacttatatgagggccatgacaactattttccatgatatgatacataaagaaatcgatgtatacgtggatgatgtgatcgtgaagtctagacagcaatccgaccatgtcagagacttgagaaaattttccaaaggcttcgcaggtacaatcttaagctcaatcctgcgaaatgtgcttttggggtgccatctgggaagttgttgggatttatagttagccggaggggtattgagttagactcgtcaaagatcaaagctattcaggagttgccacctacaagaaacaaaaccgaggtgatgaatttgttgggaagactgaactatatcagcaggttcattgctcagctcacggcaacgtgtgaaccaattttcaaattgttaaagaaatatgccgcggtcaaatggactgatgaatgtcaggaggcttttgataagataaaggggtatttgtcaaacccacctgtattggttccgccagaaccagggagacctttgattttatatctgacagtcgtggacagttcattcggctgtgtactggggcaacatgatgttacgggcagaaaggagcaggctatctactatctcagcaagaagttcacatcttacgaggttaagtatactcatctggaaaggacatgttgcgccctaacttgggtggcacataagttgaaacattacttgtcatcttacactacttacctcatatctcgcttggacccattgaagtatatttttcagaaacccatgcccacaggaaggcttgctaagtggcagatcttacttacagaattcgacattatatatgtgacacggactgccatgaaagcacaggcattggccgatcatttggctgagaaccccgttgatgaagattatgagcctttgaaaacttatttccctgatgaggaggtaatgcacgttgatgaattggaacaagctgagaagtcaggatggacacttttctttgatggggctgcaaatataaagggcgtgggaataggagcagtacttatttcggaaacaggtcagcattaccctgttacagctcgacttcgtttctactgtacaaacaacatggcagaatatgaggcgtgtatattgggattgagattagctgtggatatgggtgtacgggaagtcttggtcatgggtgactcggacctactggtacaccagattcaaggggaatgggaaatgcgggacttgaagcttataccgtatcgacagtgtctgcatgagctttgccagcgttttcaggccatagagttcaggcatattccaaggattcataatgaggttgttgacgctttggctactttggcgtcaatgttgcaccatccagataaggcttatgttgatccattacagattcaggtccgtgatcagcatgcttactacaatgtgatagaagaggaaatcgatggagagctgtggatctatgatatcaaagagtacctcaaagcggcagtatatccaacgcaggccaccgatgatcaaaaaataacaattcgacggttggcaggtgggtttttccttagtggaggggtactgtacaaaagaacgccagatatcggtttgttgagatgtatagatgcacggcaggccacagctatcatgactaaagtgcattccggagtttgcggaccgcatatgagtgggtatgttctagcaaagaagattctccgagcgggttattattgactcacgatggagcgggattgtatcagttttgtgcgtaagtgtcatcaatgccaagtacatggagatttgattcattctccaccatcagaactacatacgatgtccgcaccatggccttttgttgcatggggcattgatgttattgggccaattgattcagcagcatcaaatgggcacatgtttatcttggtagctatagattattttaccaaatgggtagaagctaagacgttcaagtctgtgactaagaaggctgtagttgactttgtgcattcaaatatcatctgtcggtttgggatcccaaaggtaatcatcacagataatggggctaatcttaatagtcatttgatgaaagagacatgtgagcagttcaagatcactcacaggcattctactctgtaccgtcccaaggcaaatggtgcagttgaagcagccaataagaatataaagaaaatactccggaagatggttgatggatctagacaatggcacgagaaattgccttttgcattgttaggatatcgcaccactgttcatacctcggtgggggtgactccttactcactggtatatggtacctaggcagtaatacccgcagaagtggaaatcccatctccgcgaatcattgcagaggctgagatcgatgatgacgaatgggtgaaaagccgtcttgagcaattgagtttgatcgacgagaagagattggcattagtgtgtcatggccaactgtaccaacgaagaatggcaagagcatacaacaagaaagtacgtccaaggaaatttgaagtcgggcaattagtactgaggcggatcttgcctcattgggcaacaacaaaaggaaaatttgccccaaactggcagggaccatttgtagtaaccagagtgttgtctaacggagcattgtatttgacagatgtggaaggaaaatgtgtagaaatggccatcaattctgattcggtcaagagatactatgtatgatttctttattttattttctgaatgtatttgtttgtatctggcgtatcttaaagattgaaatgatgaaggcattttgtcctgctatccaaacactcttatcccttgttatccccttcgagccttacttatttttcatatccctcttccggaattagcggcgctatcaaagaacacaggtgccgaacataaaggaaagaagagaaaacaaaaggaaaagaaagaaaagaaaagaaagaaaagaaaatgaaaagagaagaaaagaaaaaaagagaagaaaagaaaagaagaaaaaaaggaaaaagaagaaaagaagagaaggaaaaaaggaaaaagagaagaaaagaaaaagaaaggaaaagaaagaaaagcaaaagaaagaaagaaaatcacaacaacaaaagttaaatacagtgaactacgtttgacttgatcccgaaagggtacgtaagcagccttaccccgaggtttagtaataccaaaacaaaaatccaaaaaaaatccccaagcaagaaactggggcagaatttgtgattgttatgaaagttggattccgaaagttgtaatttgaacccattcgatttgttttgagccttttatacctttctttctaaacccaatccaaaaacctacattacagtccaaagaaagaccttttgatcaatctctaagaaatgccaggtcgagcaggtgacagtaattcgtataagtgtccacactctggttcaaacaagaaagaacgaaagcaaaaatgagagagccttatcggtgaaaaccctcacgggcaccgtaaggcgacgggagctgagagagaaataaatgagagagtcctattggtgaaaaccctcgtgggcacctttaggcgaaagtgagttggaagatggttaaaaggcaaaaggtttgtgagtggaagaatgttttgtggtaccgtaggaaaacaaggttaaggtctgggtaattcaaacaattgatgaatttctgggcaatgaagcatggcaactgagagttttttagtcggattgttcgggccgattaatccgaaatgcatgtcatggtcattggtgctagctgttctggtcagataagtttctttctttacttcattttagtagtcatccggttttggattcttcttatccttaacctgttaaaaccattgcatttcattctcttttgggggattttgtttgtctaaatgttctaatgtcaattatgttcaaaagcaagtgggaaaggatttcaaggctcactaccagcttccggaattgtaaagcacaacgtggtcagagcatgtcaaaacaacatgaggtaaaatggaataagggaagtcgccggaagttgcatcggtagaatatttgggaaatgttatgggaaatatgaaggttcaagcaaaagggccggaaagatgagacaacagtatgggtacaaaggcattcaggtggtcaaaaattgggggaacgtggaagtcggttggaaagtcgggcatttccaaggatatcgggcaatacaaagcaaggcaatggaaggacgatgcagcaagaatgccatcaactaaccaccgtttttttttaaaactaacgaaattttcagtgattgaaacaggggcagaaaattgtttgtcatgaataattcgccatgagggaagagcggctcgcaggtttaggataaatgcaagttgtcaggagtccccctggagaacagagacatacttttcaagtttgatgtcaggagtccgcctggagaatagagacgttcaatttcaaatttagcagtcaggagtccgcctgaagaatggagacatgcactttaaattttaaaagtcaggagtcctcctggagaatagagacgttcagtttcaaatttagcagtcaggagtccgcctgaagaatggagacatacagtttaaattttaaaagtcaggagtccgcctggagaatggagacgttcagtttcaaatttagcaatcaggagtccgcctggacaacggagacacacaattcaagttttgggaagtcaggagtccgcctggagaacagagacacgtattttgaatttcagtagtcaagagcccgcctggaaaatggaggtgttatatattttaagtagtcgaagtcaggagcccgcctggataatagaggagtagtttcaattttaagttcggcagtcaggagcccgcctgaataatagaggaatacattcaagttcgagtttatttaagtttagcagttgggagaaaggtaaaaacatctcagtcaaccagggaatagcaacatggatttttatcgataaagaacaaggcaacaaggaagtacaagagcaagtttgaagaatttagataggatttttataattcatagagcatagttagtttagcttcttttatctttgacacgatgtaataagggaggtcagcagcagtaacagcaacaagcacagtgcagtcacagttcctggtagtcccagctaccagacactcccgaactacactgacctgattcctgtttagcccaggatatgtaggcaacctccgaagcaggatgcggtcaagcttttcaaaatgcttcacacagaattttcgaacgggcaaaattcgctcgtatttgctcacttgtctttgcccggaaacctttcgtgttcccgagcaaagaggggcagttgtgagcacgtgatttttgccctatatatgaataattcccaaaatcccaaacaaaataatttttcttttgtttttacaatttttgtgtgttttggtgtcatcttctgataattgttgcattttatttgtgcgcgttaatttttataaaatacaaaaatacgcatttttctgcatttaggatttaattttatactttagtattaattagggattaacctgttttggaataggatacgaagaaaatgacaaaaatagtccactttaacgtttttattattttaattgtgagacagtcgcaaatagttatcaatttaattttaggcgttaattggttgtagcttaattgttagtttaatttcccatctttggaaaaaatcagaaaaaataaatacaaaaatacaagattgcaaaatgaaaaatggaaaattattgttaaaagaatatagagagttcttgtttgagacccgaaatttgggccaaatgcaccaaatatttcaggcccaaacgcatcaaacactttaaaatgagtccagccaagtccctacccggtctgccccccctttaaatgaaacggcgtcgtttcagggcccttggatcaggaccgttggatctcatcaatccaacggtccggaactaacgaggtttccagtatataagtgtccaaaccgttccccctacccccgtttccatcgtcttcttcaccctacccttctccccaaaccctaatccacgccgccctaaaattccttgcaggcggtgaacgcgaactacgccgttcaccctggaattaacaccatgggttcccctcaccctcctcttgctattacacccgatggtttgcctcgaataaggccggaactcttcgaatcttgatttgaagttttccggccaggtgacaatttgtccgaatcagcccaaaatcacaccctacaacccccagtccttcctcaacactaatctgtggttgttttctttcaaatcaccttgaaacgacccaaatcttagatctaagaattgctgaccaaaccctaaaatcaaatccttttaatttcaaaccgtagcacccttaaccatgtgttctcgtgtaagaacacatggttagggatgttatgcgtcaaaaatctgaaagggttcagatgtttacgactggccggaaccccttttccctttgtgagttttttttactgtttcttttgctagcatgattaaaatgttatttgcagtcgttgtttcattattgttctgttaattttatggtttaattgtgttagtttaggtcctgttaattactgttaattctgagattgttagttggttgaatgattataagttcacggtttaataattagttttaagttcatttaatgttaatagtggtagcttaagctcagtttaatttcattttagcttatttgagttggttaattgaatagaattgggtcagtcagtctgattagttggtttctgattgctagctaattaattttagttagtttctgattgctagttaattagtttttagttagtttcagattaggttagggtattgggtatagttgttaaggataaaggtaggttcagtaattctgaaaggctttcaggggtaagctgggtatggaaaagggcagttctgataggaatagtaatatcaaggtatatggaagggtagtatgggtattgtatgggtagaggaatgctttagggccttccagaatgggtttcaagtgtaaaatttaataagtgtactgcagttacttgtttagcaagatagaaatagagggaccaaaatgaaaataaggagggactaattagaaaatcagaacttagtttattctctttgggtttgcctataaaaagggcataagatgccttgggaaagggggcagctctcaatcttctgccttgagccttaaaattttaatttgagctttcatttttattctgttagcatttcaattctgagggtattcagaaaataaaaacatcaaaatatggaaatctgaaacagtttcagaatccccttactagttttggacttcagctgtgagggacagggttatgttagactgatctgtgggaattggcttacatttctgatttttgaagtagtctgtctatgtttctgtggcatcacattgtcgggtttgttgctgttgctgttcaaagtacctgactcttcaccttttctctatttcacattccaatttccaggtacatttccatgaatctcactgatgtatgttcgttgaagttgaattgaagtgttccaaggcctgttattcaactgaaagtagcctgtatctttaatgatagtagtagtgtagtctcttgttatgtaattggcagaatgtgcataattaaacttgttcagtagggtagattacatgttgaatgatgcatagtttagaactgttgaattggacatttgaataagctttgagcatgggcccgggctgatctgaaaattcgtgtgaattcccttagtcatcagaaacaattagacctgtgtacatgacatgaaattcatgagcaagtttgatgacatttagcttagtcattggtattttgtcattatagtgtaatagaaggtttgcttttgttttaagattctgaaatcgtttggaagatcataattatggtaagtaaattggtatagaaatcagttggaaatcatgaagcaaactcattcataattgacttaattcattaaaaaaagcaggtcgtgataggcaatgtggaggatagatcatttatggaatctgagaattcacgttttcagtataaggattcattgttacaataagaataaacctatcttcattgggccgctcggatcatgctaaggccacaggcaggcccaattctcctttaaatttggtccttattttatttcattacaatccatttccaaattaactagtcttttagaggcatacaaataagtagagaatcgtagctattttggaattactgctagccttgccggaataaatcacgtgcgcaaactgttaacagtgggctactaaaatgattagaaattgggatggccatttagcaaattccatggtcctctttaaaatcatgttacattagaatttttaagcacgacttccttaagaattaccttcctaaactcaggtgcgcattgatgcgacccaaatccaaatctcgatgaagccgaaaggtgtcgataatcgcgggtgcattgattgcgacgtggttcgaaatacgttttcgtgacatcgtaattcttataaataaataatgatagaaaagaggttttctgcaaattgatacgggccttaccgcacaaaataaataaatgtggggcccttagtaaataattatcgaaatatttagaacttggaaaggttgtttagtgaatttcaccgccttccccaaaataacaatactttagtatctttagacacgatttaattattactttcttaaaattagagtgcgcattgatgcgactcaaatccaaatctcgacgaagtcgaaatgtgttgataactacgggtgcattgattgtgacgtggtacgaaacgcgtcttcacgacgtcacaattcttctaaaatataattataataaaagtggttcaaaactaataaaaggcacacaagctagcatgtattaaaatcagacaaaatcaaatacaacagttaagcgaccttgctagaaccacgaaacccgggaatgcctaacaccttctcctgggttaacagaattccttatttggatttctggttcgcgtactgttaacagagtcataatttcctcggttcgggattcaaccggtgacttgggacaccattaatctctcaagtggcgactctgaataattaataattcaatcccgttccgattgtcctttaaatggaaaaactcctttacgccctttgcggggtgtaggtagtgaaaatggaggtgtgacaaatacatcttctgtttgaaaagtacataaacagagttctattaatcttaggctaccataaacaagaggctgctacaacaggaacgcagttacatcttcaatccccctcccgtcgatcatagcaacatcatcagtcaacatctgcacacaaggtgcagaagtgtagtatgagtacaaccgaccccatgtactcagtaagtaacaaaactaaccttaggttgaaggcagtgacaagctaacacaaaggtcggttccaataccaatatttcgcaatagttcatgacggcatagtacaagtaataaaagaagtatctcagaaataaaatgctcaactcgttcacagttcaaaaaaaaaataagcatgcttttcaagtatctcagtgaaaacccaaatcttataccaaaattgcctaaaatacgagtaagtttgaaaaactctgatttttcccaaaaatccttttaacaatacgtaagatgttttattttcagatagcgtgaggaaaatacatctctatgcctatatgtcaagatacaggtaaaatcataaatatcaccaaactgggtagcagaagaaaatgcatctctatgcacgcatctcaggtacacatgtcaaataaagtgcctcttaatgataaactcaggtactcacactcttagaatactcaatctcactgtcttgcattctttcttaccgtgctccatactcagcatactcaatcactcagcactgtataatatttgttgcggcatgtaacccgatccacacatatatatccataaggctcgttgtggcgtgcaacccggtccacatatatatagccataaagctcattgcggcgtgcaacccggtccatatataaatattcataaagattgttgtggcgtgcagcctaatccatatacatatatataatcagttgcgctcgctgggggtgtgcagactccgaaggggctccttcatcccaagcgctatatcgttgcggcgtgttggccgatcccataaaatataaccaatataacatgcttctgcgtgcagccccgatcccaaaatatcactctcacttaggccctcggcctcactcaatcatcaatctctccagtctcactcacgggctcacaatgtcatgaaactagcccaacaacaatgatatgatgtatcaataaataacaactgagactgagatatgatatgaatgcatgaatatgactgagtacgaaatatcaataaaataagtgagatgacaacaagaaaagaccactatgggtcctaacaatatcaacataaagcctaatcatgatatctaacatgattgacagctcagttactttatcacatggtgaaaacataaatatcaacaaaatgagtaactatatagtgtcatgtagataacagagtcacaattcacatggtgcacgcccacatacccatcacctagcatgtgcattacctcaataccaattacacaacacgtaatttggggttttacacccacaacactaagtttagaagacttacttacctctaacaagcaaatttcagtatcgagcaagccaaacgatgctccaagaatgccatctctcgcgttccgacctccaaacagcttgaaactaaccaaaacaactcaaatgctaaaggaatcaattcaaatctaaaaaggtcgaatctttaatcaaaagtccaaaatcggccaaaaaacccaacccgggcccgcacctcggaaccgacaaaaactcacaaaatccgtcaacttattcaattacgagtctaaccatactagtttcactcaaatccgactccgaatcgaggttcaaaactcaaatttcatattatgaaactttaagccaaaactcccaatttcctttttaaaaattcatcaactaaagctaaaatcaaaggtagattcacgaaatataactaaaatcgagtagagaacacttacctcaagtcatatggtgaaaatcacctcaaacattgcccaattccgagctccccaacttaaaatatgttaaatgaacaaaaccctcattttaacactattctgcctcgttttatgtgtcaaaagatctcgaaactaacttttgatgcctcaaatggattccttgtgaaatgctggttaagttagactctttaatcactccatttgaccttatattgaaggagatatgttggtttcaatatttgaaaatagtgcagatttttaaatacgaaatcagtggcaatttcgtaattaatctggaaaaaaaactggcaacccaattcttagtaaaatgaccataaactcctcatacaatgtctaaattcgatgattctttttgctatggcttagtaattacgatacatatctaatgcttcaataaaaacagaaattggaactcacttgcttaatgtactaccatttatgcttgaagaaacgacgtcgaaacataataaaatgagtacaacacaacccaaacctatccgaaactcacccgagtcccttgggtactcgtcctaacataccaacaagtctcataaaataataccgacttactcgaggcttcaattcacgcataataacatcaaaacgatgaatcgcaccccaaatcaaacttaatgaacttttccaaccttcaaattctaattttcacaaattagtgccgaatctttctagaaatatccaattgcaaatccgtgcatatgccggaatccaaaattaccatctggatctaacggaataatcaaaactcgaattcgaggtcaaatactaaaaagtccaacttggtcaactcttccaacttaaagcttcagtcatgaagttcattcttccaaatcgatttcgaataacctgaaaatcaaaactgtcgattcacacaagtcataatacatcatacggagctactcatacccgtaaactaccgagcgaagcgcaaatgctcaaaacaaccggtcgggtcgttacaatattatcatgttattttcttgaaaaatacattatatatttgtatcctgctagggctaaaaaaatatttggagcacaagttatataatttgtgctatgaagacataccggaaaagaaaaacccaaaatctgaaaaaaaaaaacgaaaaactcgagaaaaatcaagattaaaaaatccgactttgttggtttggtttatagatttaaaaatctgacacctttcgtttggtttggtaattaaaaaatccgaaccaacacaacctatgcacatccttccttaattaggactttattacatattttctctaggtttagtagttttcaacaaataccctagggtttttaataatttatatacaattattgtattaagtgtccaagcccgtattattttcctttaatatgccggtgatctgcgaaattagttacaagcgaaaaagattggattcatgttacctcaaaatcgattgatttgcgcccaaaatctctctttcttctttcttaccattaacaatagctctatataatcaaaataacatcgattgaatttgtattttgctacaattaaagaacaaagttcaacacataacatattcgaggaaaaaaatcattgacgatagctatgtattgccaaaaaatcgtcaattgcatcgctctggacaacactgaaaatgaagaaacattgagattgttgctagaattatttttaatgtcgttctactaaaaatatttgaattcgatattcgagttttacgattttgtgagttgtttaatttgagtgttcttgcaaatgattgagaatgtcttatggagtttatatctcaattttgaggagattagttaagtatagagttgattttaggtgaaatttcatattgaaactcgaagaagaagaagttgcaggaattgtatgataattgtatcgtaattgtatatgatacatcaatgctaaaacataattatatcatacttgtatcatacttatatcataattgtatctaacttttatttgttatattaatactcaaaaataatacttgatataatactaacacaagtaatatacaattatcatacatttgtgatactcattgtgaaattggtcacaaactcacaactgcttgtagtgatatacaattaatatgtatttattatacatttataatacaatttatgcaataattatgatacgaatacaactatgatacaatcgcaatttatttctgaaaaaactgtgatacatttatgatctgcatcttcttcagtttttaagcacaattctaaacttaaaatgtactataacatcgtattatacttgtatcaggtattgttttaggtattaatgtatcatattcaagtcacatataattttaatacatttgtgatacaattctgaaacaaatttgatacaattacccaaatacaattatgttgggtattaatgtacttgatacaagttaaatataattatgatacaattatattttaggcattgatgtatcacatataactctgatacaactatcgtacaatatgaaattttacctaaaatcaactatagacttaatcaatctccttcaaaattgagatataaactctaaaggatattcttaatcgtttgcaagaacacccaatccaagcaaatcacaaatttgtaaaactcaaatatcgaattcaaagcttcaaggttttttgatcactattaatggtaaaccctttattgctacaattttagaaataatatcgatgaatttataatagttgaagcttttgaatggttgttggtggaattgattcaaagaaatatatgatgtgcaattttaaagagatatgcgcttgatttgtgtgaaagaaagagaggttttgattgatttttatgaaaaagatagaatgattttgaaacatttataatatagtacagacaggtaaaaatctctacaataaatacatactccccctatttcactttactatttatagagttagaaaggtttttttttggaacaagggagacttttatttatataaaactaaggaacattagtacactgatccactgaatcattacacaaagcattaatgtcatctatggcatttagattaccaaaaaatgctagagttctacaagtgcttctaagcactagttttcttctaccgcttctatccctgtccgccaatatcctggccatgacatatgagggagatgtatcaaaataaactatcttattgataacagtctgactggtagcttccttggctagacggtctgctactttatttccttctctgaagctatgccgaagaccttctccttcatggacatcagcaacctgcaattatgaacaatagagttaaaagtagttttgccattttccaagatttgtaatacctatattgagtcagattcgatttccataggaagtaggtttctttctattgcgaacttcagactttgctcgaaagccataagttctgcatgggtgcatgaagcagcatgaactcttatgttgaagcccaatatccagtggtcattgtgatcacgcaccactccacctattctgcttttagctttattatgagcaccatctagatttagtttgtaccatcctagtggaggcttcctccaatttgtgctgcaactgagtctaaggtcatggttactttccctttccattagataatagaactcactttcttggttgatgatacgtggtaaggagataagattgtttgtattatttttcagattatagtttctgttaatccaaatgttctagagcaggaatgggagcaagtggttctaattgataatgttggaaggaaccaagggattactatgtctgatggcatctagccaattgtgattattatactttagcgcagtggtatcccaattaatggatttccaaaggtatgtagctatttcacaatgtagaaagatatggggaagggattcctcccctgacctacacacactgcaggttttgtcaacattcattccgatataatgaaggaaggaacggaaggggagtctattgtggcaacatttccataggaagaattttattttgtttgggcagtgtgcgtcccatacccatttgaatttattagagttattttttggcgcgggttcaggattctcaattagagagtagcatgaagccgtggagaaggatccattaatattgggttcccagagaaggtaatcataatagcgattaatgggtatagaaatgttggtgatgttattaatgatgtaggcggtagggtgaaggataacttatcaaaagatcaagtattattaactatgggatcactaatttttatttcgtgattcttaatatttaaggggccttctatacatcttcttagaaggggagtatttggaatccatctagcgctccaaatggagagggaggagttactatggattgcccataggcttcctttgttacaaatgtgccaacccttgagggtactattccatgtataggagtgcttcgattttctgttattgttgacaaatatttgagtaaggatgttggcccaaggggcagtaggtgagttaagaaacctccaagctgtactagttagtagggctaaagtcttggacttttctttacgtaatcccaaaccccttttatccttagtcattgtaattgttttccagctaataaatgaagtttctttctagattccgtagtacccgatatgaaacccctttgaattttgtcaattgagttaaggattttaacggggagaagggtgtattgcatcacgtgactagaaatacttgctagagtagagcaagcaagcgtagctctaccatcgatatttaagcagctcgatttccaaatggctaatctagctctcataatatcaagaatatattggaaatccttagctttagggatgaagttagttattgggaaaccaagatattttccaaatgaatcacattttttaattccaaaaaatttgaagatttcattaatgcagctatttggacaactttttgaaaaaataattttggatttaacaagatttacggattgtcctgacatgttgcaaaaatgattaataccatagaggatagtattacaagtcttactgttaatatggcccattagggtgagatcatctgcgataaagagatgagaaagagataaaccattcgttgatagcttaataggatcccacattttaatgttcacttggtggtttatgtatctagtgaacatttctatgcaaagaatgaaaatgtatggagatatagggtcaccttgctaataccatgacttggggtgaaccattttgtggttgtaccattgactagcacggacatagtgctagtagtaatgcataacatgatgagagtggtaatttttggagggaatttaaagtatatcaaagttttatggataaaggaccactcaagcttatcaaaggctttttctaagtcaagcttaagaatcattttgcctttcttactattacttttcctgaattgattcataatttcttgaattaaaatagtattatcactagcacgtctatttttcaggaagctagcttgaaaggggctaatgattttttccaagaagtatttcagtctattggtgatgatttttgtaatcactttgtaaattgtattacatagactgataggcctaaaattttcgaggttgttggcattggggattttaggaatgagacaaatgaaagtgctattattttccaataggatatgctgagtagcaaagatctattggcagtaggtagtaacactagggccaactatttttcaataactttggtagaaaaaggggtggaaatcatccggcctccgggctttataaggtttaaaaaagaataaagctttttgaatttcactatcacaaagaggtctatctaggctggatagatctacgtgatcaaaactctttggtagattagaattttttgacagaagatgggacgtagtaaaagcatcctcaaaataattttggacatgaagaaggatttcattaggattatcaatccagttcccagaattgtctttaaagtagcttatatgatttcgccttcttctatttatgacactaatatggaagaattttgtattggcgtcaccatcattgagccaattaattcttgatctatgtttccaatagtcctcttctaattttaggaagctattataatctttttgtaatgaattttcaagctcttgtagaaaaatactagtagcttaatgggggagcactgaatgccattaagtctagctaatattttcttatttttcttaaagatgtcccaaagattgttttactccagttggtaatattgagaacaaattcgtgtgtggctgatttaaaattattattggccttgaagtcagggtgggtcaccaaatttttcaagcctaaaaggtttgtgagaaggacatcctttaaaggagttaagcttaagaagtaagggattgtgatccaaataggttttaggtaaatatgttattgaggagcctgggaagagacttagccaattttcaatagccaaaaacctatccagtctttccatgataaggcctttgtgcctatttctgtgattaaaccaagtatacttacatcctttgaaccctaagtcgaatagtttacaattattaatatagttccaaaacgtattggttctagaatgatttattgctctagctccaaatttttcagaagccacagtaatatcattaaagtcacctcctaataaccaggctccattaaaattgctcgcaatatattctagataattccgcgtggactctcttatgtagacatttgtacttgcataaatagtactaagaaaccaataaaatttgtaggggatttcctctatcattgcatggatttcctggccccttctagtaaagttgtttacagtaacaactttgtggtcatagaagacaactaagccaccaacttggccttcagcgggcacctcgatcatttctgtgaagttataatcgttgagtagggctacatcggaggacatcctagtttcgagcaaggctactaagcaggttctatgagtatctatcagatctctaaagttcctgcgaaaatcttcattgtttgctccacgcacgttccaaaaaatgatgtttgtggctctattcatcattattggattttgatggtttgagttggtcactgcctccaaaggggaattggggttcgttctgctgcatggaactaggatcactgcataagagcccactgttgggtcccttggtggccttctatccatcgagcatttgtgcactgagggaggccagttgaatatgaactttttgctcatgttttccttgaagagtagaacctttacctcgtttaggtttgcaaactccacactcagctccgtatttagaaactccaattcttcctcctcctccatttgattttctctttgaccttgttcgttgggaggtggattgttctccatctggtttggcatgttgactagagcttggtttgcatgggagtcccatataatgagaatgggactgagcagggagatctcctttgggagaaagaaaggaagatccagagtgtgagggattgtaatatgtgggtttgctcgtggtgggaggttctagtggctttgcatggcttgaagcaggttgacattcatagatggtgcaagaggctgaagcacgttgttgatctaggtttgagtcatgaagttgttcatggctaacctcaccccctccgatataagttgggccaggtagggggtgttttggatcactgtgatagtgtcctgaccattgatctccatattgaaggagatcgcatggcccattaagcctgtttccatcctgattaggggttgatagtttggaggtagtggtggcgacgtgtagtaaacttttggatttggaagttgagggggaagggggggtaggttgttcatagttggacgaggggattgacggagaacttggatgagtctgtttctccttctaggtgagtgtggaatttttggcatattgagactgtttgggacttgaatgggagtttatactacttgtacacttgataggatgtgaggcagtagatagatttatagggttaggatatatgtgcatgggaatggggtggggaagtgtaacggatttatctgaagatttag

SEQ ID NO: 10 - DNA, 840 bp, Nicotiana sp.
  source 1..840: mol_type = genomic DNA
atggaagatcatcatcttcatcttgaattctccatttatagttcttcttcttcttcttcttcttctataacttcctcctcatttgcaaattcttctaatggcttaaattctccttcaaccaccacttcttctacttcatcatcttctttccatgagaacattaatgcaaaaaccccatcaaatggctatacttgcaaatccaagaaaagctcaaaaatagttcaagatttcaccaaaaatgggaatggtcatgggaatggggagaacaagaaaaaaagaaagaatcaaggtgatgaaaagcatccaacttttagaggagttcgtaagaggaattggggtaaatgggtgtccgaaattagacaaccaaggaaaaaatcaagaatatggctagggacttatccaacggctgaaatggcggctcgagctcatgatgtcgcagctttagccattaaaggtaactcggcttatcttaatttccctcatttagccgatcaactcccacgaccagcctccacttcccctaaggacatccaagcagcagccgctaatgcggccactagtacgtttctcgagaaaaattccgtcagagatgaagttgagtcccaaattaaactgcacagttcacattcatcgatgaatttagccttagagaacacacaagaattgctaaattctccatcgatagaccacgatgacacattttttgatctacctgatcttaccatcgatcaagtggaccaaaatgaccgttatcaatacccaatctcaacgtggcagctggctggagccgatagcggaatatttcggctcgaggagccatttttgtgggagtgctattag

SEQ ID NO: 11 - DNA, 840 bp, Nicotiana sp.; identical to SEQ ID NO: 10
  source 1..840: mol_type = genomic DNA

SEQ ID NO: 12 - DNA, 666 bp, Nicotiana sp.
  source 1..666: mol_type = genomic DNA
atgcagggaatatcattagagtttgatcagcaaaattttcttgacaccatgcagcatctcttcaatgatcccgactttccccaaatcttttcagaactaaactcattcaataacaccatccaaacacctagaaacccaggttcagagaacaccatatttgcacaaaacatggttcaacgcaatcaagaaaaatatgcagatgatcatatcgtcccattgcaaaagacttcgtcagaaaatgataaggagccatcttcagatcaggtgcctttggaaaagaagaaatacaaaggagttaggagaaggccatggggaaaatatgctgcagaaataagggatcctgaaagaaaaggcgctagactttggctagggacatatgaaactcctgaggatgcagcattggcttatgacagaactgcatttaaactgcgcggttcaagagctgtactcaatttccctcacttgattgaatctaatgttactgaaattaacagagtgaggccaaggagacgttcacgttcaccggatattgagctttcatctgatcagcatgatggtccgatttcaaagaggagaaatgttgacctaattaacagcttagctacagccaacttggatagccaaattatcgtggagagatgtttaacgtctagtttttttgcctga

SEQ ID NO: 13 - DNA, 720 bp, Nicotiana sp.
  source 1..720: mol_type = genomic DNA
atggcaatggaaatgaatccagctgacgaaaccttgtttttctccgactctcatctccttgaatcgataaagcaacatcttcttgacgattcagatttttctgaaattttttcgtcgatgaattctagcaacgaaatattgcctaacagtcctagctcaagttttagcagcttcgacttcgactgcagcttccttaattgggatgaaaactctgaggaaacattaataccaactgatcagaatccttcacatgaatcccatgaaaagtactccgagtccgaggagaaaacccagggccctggggtggcgcgtgagaaaaacgcgccgcgagattggacgcggtacataggagtgaaacggcgaccgtgggggacgttttcggcggagacaagagacccaagtaggaaaggtgaaggtgcaaggctgtggttaggaacttacgagaccgcagaggatgcagcgttagcttacgatcaagccgctttcaaaatccgcggctcgagagctcggctcaattttcctcacttaatcggctcaaacatgcctaagccggctagagttacagcgaggcgtagtcgtacgcgctcacccgagccatcgtcttcttcatccacctcatcatcagaaaatgtaccaaggaaaaggaatatagatgtgataaattccatagccaaagccaaattcctttgtcatagcttgaatttacagagattagcttaa

SEQ ID NO: 14 - DNA, 1167 bp, Nicotiana sp.
  source 1..1167: mol_type = genomic DNA
atgggggacgtttgcggcagagatataagagatccgaataggagaggcgcgagactgtggctaggaacttatgagactccggaggatgcagcattagcttatgaccaagccgcttttgagatccgcggctcgaaagcacggctcaattttccgcacttaattggctcgaacatgactaagccggctagggttacagcgaggtttcgtatgcgctcaccggagccatcgtcttcagcttcttcagaaaatacgacaaggaaaatgaagatagatgtgataaactccatagctaaagtaaaatttattcgtcatagcttgattaatctacaaatgttggtataattgtgaggaagtaaggtttcttcgtgtttaacaattgcaatataaattatggaggcggtttcaggattttaattttatgggttcaaatttctaattctaccgctttcatctaattaactaggttcaaagtctattatttttgcacatttagtgaatcttttaaaacatatacatagtctatgccaaaatttagggaggttcaaaaccaaaccttaaccaaaaattgaaccacaaaattggcttaatgtcttatttgtatcgggttatcatattaactgttggtgagtggattgaaattttataattaacgatttattggttttgaggcgaattattcaattttcttaacggataaaccgttaacccgttaagaatttttatatttgtattttttacccttatgtatattaaatatccttccactatttaacaaacactacaagaaatatgtgatacggcgacatttaattagtgacaattaagataaatgtccgaaaaaagttaatttagtgacatttgttagaaaatgtgataagaataccgacatttgttgaaaacatgtcaaaaatattttgacatttgatttaaatgtcatattattaggaatataacaacatttaattagtaacatttataacaaatgttaaaaataattttttcgcccaacaagaaaaaataactttaagcactttatgggcctttaaacttctcttctttttacagaaatacaagaaagttaaaaataacattcaacccgattcctccacaactcttcaagccgcaaccatctccgtatctttcactcattttgatccaaatccgccg

SEQ ID NO: 15 - DNA, 654 bp, Nicotiana sp.
  source 1..654: mol_type = genomic DNA
atgaatccccttgataatgcaaccttctttttctctgaccttgattttcttgactctattgagcaccatcttctgaatgattccgatttttccaacagtttttcgccgattagctcgagcagtgtcgcaactcctaatagtcctagctcatgtttttgcagctgccttttggatgaaaacattgaagaaacaacaactctcgaatctcaatccgagcccgaggagccaacgcaaggcttaaaggcggcgcgtgcggaaaacacgaagcaaaattggaggcggtacataggagtgagacggcgggcttggggaaagtttgcggcggagataagggacccggagagaagaggcgcgagattgtggctaggaacttatgagactcctgaagatgcagcattggcgtatgatcaagccgctttcaaaatccgcggttcgagagctcggctcaattttcctcacttaattggctcaaacatgcctgagccggctagagtaaaagggagacgtcataattcacgctcactggagccatcgtcttcttcatccaccacatcatcggaaaatggaagaaggaaaagaaatatagaggtcataaattctatagccaaagccaaattggttggtcatatacgcgatctagagatgtcactataa

SEQ ID NO: 16 - DNA, 672 bp, Nicotiana sp.
  source 1..672: mol_type = genomic DNA
atgaattcagcagatgtaaccttctctttctctgattttaatctccttgaatccattaagcaacatcttttaaatgattcagatttttctgaaactctgtcgcctatgagttcaagtaacggattgcctaacagtcctagctcaggttttggcagctccctttcagcagaaaatagcttcgaaatctccctttcggaccaaaactttgaggaaacaataccaaatctcgaagaaaagtctgagtccgaggaggaaatgaaggggaatgtggtggcgcgtgagaataacgcgccggaagattggaggcggtacataggagtgaaacggcggccatgggggacgttttcagcggagatgagagaccccgataggaggggggcaagactgtggttaggaacttacgagaccgcagaggatgcagcgttggcgtacgatcaagccgctttcaaaatccgcggctcgagagctcggctcaattttcctcacttaatcggttcaaacatgcctaagccggctagagttacagcgaggcgtagtcgtacgcgctcacccgagccattgtcttcttcgtccacctcatcatcagtaaatgtaccaagaaaaaggaaaatagatgtgatcaattccatagccaaggtttgtcatggttggaacctccacatgttactataa

SEQ ID NO: 17 - DNA, 684 bp, Nicotiana sp.
  source 1..684: mol_type = genomic DNA
atgaacccagctaatgcaaccttctctttctctgagtttgatttccttgaatcaatagaaaaccatcttctcaactatgattccgatttttctggatttttttcgacgatgagttcaagtaacgcattgcctaatagtcctagctcaagttttggcagctccccttctgcagaaagtagcttggatacctctctttgggatgaaaactttgaggaaataataccacatctcgaagagaagtccgagtccgaggaggaaacaaaggggcatgtagtggcgcgtgagaaaaacgcgacgcaagattggagacggtacataggagttaaacggcggccatgggggacgttttcggcggagataagggacccggagagaagaggcgcgagattatggctaggaacttatgagaccccagaggatgcagcattggcgtatgatcaagccgctttcaaaatccgcggctcgagagctcggctcaattttcctcacttaattggatctaacatgcctaagccggctagagtaacagcgcggcgtagccgtaggcgctcacccgagccatcgtcttcttcatgcacctcatcatcagaaaatgggacaagaaaaaggaaaatagatgtgataaattccatagccaaagccaaattggtttgtcatggatggaacctccagatgttactataa

SEQ ID NO: 18 - DNA, 564 bp, Nicotiana sp.
  source 1..564: mol_type = genomic DNA
atgaattcagctgatctttccctccttgaatccatacagcatcatcttctaaatgattctaatattccagaaatcttttcagctatggattccaatagccctagttcaagttttagcaactctccttctacagaaaacaacttttactatggtgaattaacaccattgataaaccctactttagtaggcgccactgaaaagtctcatgaatttgaagagactaataataaggagactgtggcggcgaaggtggcaaacgcgccacaagattggaagcggtacagaggcgtaaggcggcggccttggggcaagttcgcggcggagataagggatccgaataagaaaaatgcaagattatggttaggaacatatgagacaccggaggatgcagcattggcttatgatcaagccgctttcaaaattcgtggctcgaaagcacggctcaattttcctcacttagtcggctcaggcatgccggagccggctagagtgaaccctaggcgtcgctcgcactcgccggagtcgtcatctgaaaacggaacaccaagaaaactatttgtgtaa

SEQ ID NO: 19 - DNA, 627 bp, Nicotiana sp.
  source 1..627: mol_type = genomic DNA
atgtacgaacaaacaaccatctcagattctgatctctccgtccttgaaaacatcaaattccatcttctaaacgataatgatttttcacagatatattccacgtttgatcaatgttttagtaatgcagaaattattaatagcccggactcgagttttggtagctctccaacagaagaaattagctggggcgatatgttaactagtgtcaataccacgtggcaacgagtcgataatttggagtacaaggaggaaacaaagaagaaccatgtggtggcgcgtggtgtgcacgcacctcaggattggaaccggtacagaggtgttaggcggaggccgtggggtaaatttgcggcggagataagaaaccctgataggaaaggcgccaggctttggctaggaacttacgagacacccgaagatgcagcattggcttatgaccaagccgcttataagatccgtggctctaaggctcggctcaacttccctcacttaatcggctcgaacatatccgagccggttagagtggctccgaggcggcgttgcctttcgccggagatttcatcatcttctttttcgttgtcatttgtaaaaaatgtacctctaaagaagagaaaattggctgaaaattga

SEQ ID NO: 20 - DNA, 348 bp, Nicotiana sp.
  source 1..348: mol_type = genomic DNA
atgcagcctggaatttcatcagaaatatttgacctaagcaatattctaagctacgattccatggaacatttctgtgaagattcttcctttccagaaatgagctcattcaataatattattggttcttcccaaaatattaaccctagcagcagcacaaatgaccaaaaaagcaatgaaaagggagatactgctcctacttcattacaaccgtgccataaccaaggaagtaagtcgcgtggtgtacacgatccaccaaactggaggagatacagaggcgtgaggcggcgcccgtggggaaagttcgcggcagagataagggatcctataaggaaaggcgctaggctttag

SEQ ID NO: 21 - protein, 115 aa, Nicotiana sp.
MQPGISSEIFDLSNILSYDSMEHFCEDSSFPEMSSFNNIIGSSQNINPSSSTNDQKSNEKGDTAPTSLQPCHNQGSKSRGVHDPPNWRRYRGVRRRPWGKFAAEIRDPIRKGARL

SEQ ID NO: 22 - protein, 221 aa, Nicotiana sp.
MQGISLEFDQQNFLDTMQHLFNDPDFPQIFSELNSFNNTIQTPRNPGSENTIFAQNMVQRNQEKYADDHIVPLQKTSSENDKEPSSDQVPLEKKKYKGVRRRPWGKYAAEIRDPERKGARLWLGTYETPEDAALAYDRTAFKLRGSRAVLNFPHLIESNVTEINRVRPRRRSRSPDIELSSDQHDGPISKRRNVDLINSLATANLDSQIIVERCLTSSFFA

SEQ ID NO: 23 - protein, 239 aa, Nicotiana sp.
MAMEMNPADETLFFSDSHLLESIKQHLLDDSDFSEIFSSMNSSNEILPNSPSSSFSSFDFDCSFLNWDENSEETLIPTDQNPSHESHEKYSESEEKTQGPGVAREKNAPRDWTRYIGVKRRPWGTFSAETRDPSRKGEGARLWLGTYETAEDAALAYDQAAFKIRGSRARLNFPHLIGSNMPKPARVTARRSRTRSPEPSSSSSTSSSENVPRKRNIDVINSIAKAKFLCHSLNLQRLA

SEQ ID NO: 24 - protein, 132 aa, Nicotiana sp.
MGDVCGRDIRDPNRRGARLWLGTYETPEDAALAYDQAAFEIRGSKARLNFPHLIGSNMTKPARVTARFRMRSPEPSSSASSENTTRKMKIDVINSIAKKYKKVKNNIQPDSSTTLQAATISVSFTHFDPNPP

SEQ ID NO: 25 - protein, 217 aa, Nicotiana sp.
MNPLDNATFFFSDLDFLDSIEHHLLNDSDFSNSFSPISSSSVATPNSPSSCFCSCLLDENIEETTTLESQSEPEEPTQGLKAARAENTKQNWRRYIGVRRRAWGKFAAEIRDPERRGARLWLGTYETPEDAALAYDQAAFKIRGSRARLNFPHLIGSNMPEPARVKGRRHNSRSLEPSSSSSTTSSENGRRKRNIEVINSIAKAKLVGHIRDLEMSL

SEQ ID NO: 26 - protein, 223 aa, Nicotiana sp.
MNSADVTFSFSDFNLLESIKQHLLNDSDFSETLSPMSSSNGLPNSPSSGFGSSLSAENSFEISLSDQNFEETIPNLEEKSESEEEMKGNVVARENNAPEDWRRYIGVKRRPWGTFSAEMRDPDRRGARLWLGTYETAEDAALAYDQAAFKIRGSRARLNFPHLIGSNMPKPARVTARRSRTRSPEPLSSSSTSSSVNVPRKRKIDVINSIAKVCHGWNLHMLL

SEQ ID NO: 27 - protein, 227 aa, Nicotiana sp.
MNPANATFSFSEFDFLESIENHLLNYDSDFSGFFSTMSSSNALPNSPSSSFGSSPSAESSLDTSLWDENFEEIIPHLEEKSESEEETKGHVVAREKNATQDWRRYIGVKRRPWGTFSAEIRDPERRGARLWLGTYETPEDAALAYDQAAFKIRGSRARLNFPHLIGSNMPKPARVTARRSRRRSPEPSSSSCTSSSENGTRKRKIDVINSIAKAKLVCHGWNLQMLL

SEQ ID NO: 28 - protein, 187 aa, Nicotiana sp.
MNSADLSLLESIQHHLLNDSNIPEIFSAMDSNSPSSSFSNSPSTENNFYYGELTPLINPTLVGATEKSHEFEETNNKETVAAKVANAPQDWKRYRGVRRRPWGKFAAEIRDPNKKNARLWLGTYETPEDAALAYDQAAFKIRGSKARLNFPHLVGSGMPEPARVNPRRRSHSPESSSENGTPRKLFV

SEQ ID NO: 29 - protein, 208 aa, Nicotiana sp.
MYEQTTISDSDLSVLENIKFHLLNDNDFSQIYSTFDQCFSNAEIINSPDSSFGSSPTEEISWGDMLTSVNTTWQRVDNLEYKEETKKNHVVARGVHAPQDWNRYRGVRRRPWGKFAAEIRNPDRKGARLWLGTYETPEDAALAYDQAAYKIRGSKARLNFPHLIGSNISEPVRVAPRRRCLSPEISSSSFSLSFVKNVPLKKRKLAEN

SEQ ID NO: 30 - DNA, 699 bp, Nicotiana sp.
  source 1..699: mol_type = genomic DNA
atggaaatgaatctagctgacgaaaccttgtttttctctgagtctcatctccttgaatcgataaagcaacatcttcttgatgattcagatttttctgaaattttttcgccgatgagttcaagcaacgaaatattgcctaacagtcctagctcaagttttagcagcttcgactgcagcttcctcaattgggatgaaaactttgaggaaacattaataccaactgatcaaaatccttcacatgagaagtgctccgagtccgaggagcaaacccagggcccagcggtggtgcgtgagaaaaacgcgccgcgagattggacgcggtatataggagtgaaacggcggccgtgggggacgttttcggcggagacaagagacccaagtaggaaaggtgaaggtgcaaggctgtggttaggaacttacgagaccgcagaggatgcagcgttggcttacgatcaagccgctttcaaaatccgcggctcgagagctcggctcaattttccccacttaattggctcaaacatgcctaagccggctagagtaacagcgaggcgtagtcgtacgcgctcacccgagccatcctcttcttcatccacttcatcatcagaaaatgtgccaagaaaaaggaatatagatgtgataaattccatagccaaagccaaattcctttgtcatagcttaaatttacagagattagcttaa

SEQ ID NO: 31 - DNA, 1173 bp, Nicotiana sp.
  source 1..1173: mol_type = genomic DNA
ttttcagaaatgaacgtgactgcagttctagagatatatcatttctttaattgatgaagatcagtacattatttaatttatcatcaaacattattagaataatgaaaataaaaaagcagaacatacacgtgcttaaaattgcaccttcacggaaattccaaaaagaaaataaaggtaatgcagagtctagagctacaatttgaagggcaagcgtataaatagtcgtacgcaataagccctagtaagaacaagttcaagaaactattcatccaaaacctaattagggcaaaagaaaagaaaatgaatccagctgataatgcaaccttctctttctctgacgttgattttcttgactctattgagcaccatcttctgaatgattccgatttttctaacagtttttcgccgatgagttcgagcaatgtcgcaactcctaatagtcctagctcaagttttggcagctgccttttggatgaaaacattgaagaaacaacaattctcgaatctcaatccgagcccgaggagggtggaaaggcagcgcgtgaggaaaacacgaagcaatattggaggaggtacataggagtgagacggcggccgtggggaaaatttgcggcggagataagggacccggagagaagaggcgcgagattgtggctaggaacttatcagactcctgaagatgcagcattggcgtatgatcaagccgcttttaaaatccgcggctcgagagctcggcttaattttcctcacttaattggctcaaacaatatgcctgagccgactagagtaacagggatacgtcataattcacgctcacttgagccatcttctacttcatccaccacatcatcggaaaatgggactaaggaaaagaaatatagaggtcataaattctatagccaaagccaaattggttggtcatatccgcgacctagagatattaatataactattcgaaaggaagagttttcagttctttttccaaatgcagcaacattactgcataaataacttactgttcaatcatgttattttcattagtatgttcgttatttatgttttgtatgtagtaattaatgctcattaaattaaatgagcgtaattttttcaaagacaatatgcataatgcagagaaggaatacccgatcgaataagcaaagttctaagaaaccg

SEQ ID NO: 32 - DNA, 576 bp, Nicotiana sp.
  source 1..576: mol_type = genomic DNA
atgagttcaaataacgcatcgcctagtagtcctatctcaagttttggcagctccccttcagcagaaaataacttgaacacctccctttgggatgaaaactttgaggacacaatacaaaatctcgaagaaaagtccgagtctgaggaggaaagaaaggggcttgtggtggcgcgtgagaaaaacgcgccgcaagattggaggcggtacataggagtgagacggcgaccgtggggaaagtttgcggcggagataagggaccctgagagaagaggtgcgagattgtggctaggaacttatgagaccccagaagatgcagcattggcttacgatcaagccgctttcaaaatccgcggctcgagagctcagctcaattttcctcacttaattggatcaaacatgcctaagccggctagagtaacagcgaggcgtggtcttacgcgctcacccaagccatcgtcgtcttcatcaacttcatcatcagaaaatgtgacaagaaaaaggaaaatagatgtgataaattccatagccaaagccaaatcggtttgtcatgtttggaacctccagttgttactataa

SEQ ID NO: 33 - DNA, 1177 bp, Nicotiana sp.
  source 1..1177: mol_type = genomic DNA
gtaaagaattagagttaatattttcagcttcttagagaacatatacctaattaattaagcagcatatgttttcataaaaagacgttttttaaacagcggatatccaaatataaatcttttaacaagtttctaaaagacatttttgcataattttcttagaaagttctctagaaactcttgatcagacggtttcttagaactttgcttattcgatcgggtattccttctctgcattatgcatagtgtctttgagaaaattatgctaatttaacgagcattaattactacgtagaaaacataaataacgaacgtacgaatgaaaataacatgattgaacagtaattatttatgcggtaatgttactgcatttgaaaaaagaactgaaaactcttccttccgaatagttatagtaacatgtgtagattgcggatatgaccaaccgatttggctttggcaatagaatttattacatctatatttcttttccttgtcccattttccgataatggggtggaggaagaagacgatggctccagtgagcatgaattgtgacaactcccttttactctagccggctcaggcatgtttgagccaattaagtgaggaaaattgagccgagctctcgaaccgcggattttgaaagcggcttgatcgtaagccaacgctgcatcctctggggtctcataagttcctagccacagtctggcacctctcctgtcggggtcccttatttccgccgcaaactttccccacggccgccatctcactcctatgtaccgcctccaatcttgcttcgtgtttctctcacgcgccgcctttccgccctgcgtttgctcctcggtctcggattgagattcgagagttgttgtttcttcaatgttttcatccaaaaggcagctgccaaaacttgaactacgactattaggagttgcgacgttgctcgaactcatcggcgaaaaactgttcgaaaaatcggaattaatcagaagatggtggtcaatagagtcaagaaaatcaaggtcagagaaagagaaggttgcattatcagctggattcatttctttttgttgccctaattaggttttggatgaatagtttcttgaacttgttcttactaggacttattgcgtacgtctatttatacgcttgcccttcaaattgtagctctagactctgc

SEQ ID NO: 34 - DNA, 1108 bp, Nicotiana sp.
  source 1..1108: mol_type = genomic DNA
tgttgtgggttgaatttcctagtgggcttagtttttttttttaaattttttttcttcaatttttttctttatcagtttactccgtggaaaggaatatctctaccaatttggatggagctgctagtttttttttttttttgctgctaattattttgcttggaaggcatagctcccgatttcaggagctttaggtgattattctaaattctaatacaaaaaaatagaatacccttaattaattccttccaaatacagttatagcagcatttgtaggttccagctatgacgaataaattttgctttggctatggaatttatcaaatctattttcctttttcttgtccccttttctgatgatgaggtgcatgaagaagacgatggctcgggtgagcgcgtacggctacgtctcgctgtaactctagccggcttaggcatgtttgatccaattaagtgaggaaaattgagccgagctctcgagctgcggattttgaaagcggcttgatcgtaagccaatgctgcgtcctctggggtctcgtaagttcctagccataatctcgcgcctcttctctccgggtcccttatctccgccgaaaacgtcccccacggccgccgtttaactcctatgtaccgtctccaatcttgtgtcgtggttttctcacgcgccaccacatgcccctttgtttcctcctcggactcggacttttcttcaagttggagatttggtattgtttcctcaaagttttcatcccaaagagaggtatccaagctattttctgccgaagggaagctgccaaaacttgagctaggactattaggcaatgcgttacttgaactcatcggcgaaagaatttcagaaaaatcggaatcataattcagaagatggttttctattgattgaaggaaatcaagctcagagaaagagaaggttgcattattgggattcatttacttttctatagatatttggatgagtagtttctttcactttcacttactagggtttattaattctggatgaatagaattgttgatatcctacgtctatttatatgcttggcctatgattggagctctagtccctacctttattttttgtaaggaatttctg

SEQ ID NO: 35 - DNA, 683 bp, Nicotiana sp.
  source 1..683: mol_type = genomic DNA
gaatccataaagcaacatcttctaaatgattcagatttttctgaaattctttcgccaatgagttcaagtaacgcattgcctaacagtcctagctcaagttttggcatctccccttcagcagaaaatagcttcgaaacctccttttgggatgaaaactttgaggaaacaataccaaatctcgaagaaaagtgcgagtccgaggaggaaacgaaggggaatgtggaggcgcgtgagaagaacgcgccgcaagattggaggcggtacatagtagtgaaacggcggccatgggggacgttttcagcggagatgagagaccccgataggagaggggcaagactgtggttaggaacttatgagactcctgaggatgcagcattggctccgctttcaaaatccgcggctcgagagctcggctcaattttcctcacttaattggctcaaacatgcctaagccggccagagttacagcgaggcgtagtcgtacacgctcacccgagccatcgtcttcgtcgtccacctcatcatcagtaaatgtaacaagaaaaaggaaaataaatgtgataaattccatagccaaagctaaatcggtttgtcatggttggaacctccagatgttaatataactatatttggaagggtatatatttagtgttttagtattagaataacgtttttaaattttt

SEQ ID NO: 36 - DNA, 1124 bp, Nicotiana sp.
  source 1..1124: mol_type = genomic DNA
atgcataacataaatgtgcttaaaatggcaccttcacggaaattccttacaaaaaataaaggtagggactagagctccaatcataggccaagcatataaatagacgtaggatatcaacaattctattcatccagaattaataaaccctagtaagtgaaagtgaaagaaactactcatccaaatatctatagaaaagtaaatgaatcccgctaatgcaaccttctctttctctgagcttgatttccttcaatcaatagaaaaccatcttctgaattatgattccgatttttctgaaattttttcgccgatgagttcaagtaacgcattgcctaatagtcctagctcaagttttggcagcttcccttcagcagaaaatagcttggatacctctctttgggatgaaaactttgaggaaacaatacaaaatctcgaagaaaagtccgagtccgaggaggaaacaaaggggcatgtcgtggcgcgtgagaaaaacgcgacacaagattggagacggtacataggagttaaacggcggccgtgggggacgttttcggcggagataagggacccggagagaagaggcgcgagattatggctaggaacttacgagaccccagaggacgcagcattggcttacgatcaagccgctttcaaaatccgcggctcgagagctcggctcaattttcctcacttaattggatcaaacattcctaagccggctagagttacagcgagacgtagccgtacgcgctcaccccagccatcgtcttcttcatgtacctcatcatcagaaaatgggacaagaaaaaggaaaatagatttgataaattccatagccaaagcaaaatttattcgtcatagctggaacctacaaatgttgctataactgtatttaatttggaaggaattaattaaggttattctatgtctttgtattagaatttagaataattccctaaagctcctgaagaacgaaacttgtaaacatctctctgtctccgtatcatgttctaatttaacatgaaattacatgagcgcatcataaatataactaaatctgttcgatatatcaggataataatttttcattaattagtatatttctatcaacgacaatatgcttagta

SEQ ID NO: 37 - protein, 232 aa, Nicotiana sp.
MEMNLADETLFFSESHLLESIKQHLLDDSDFSEIFSPMSSSNEILPNSPSSSFSSFDCSFLNWDENFEETLIPTDQNPSHEKCSESEEQTQGPAVVREKNAPRDWTRYIGVKRRPWGTFSAETRDPSRKGEGARLWLGTYETAEDAALAYDQAAFKIRGSRARLNFPHLIGSNMPKPARVTARRSRTRSPEPSSSSSTSSSENVPRKRNIDVINSIAKAKFLCHSLNLQRLA

SEQ ID NO: 38 - protein, 200 aa, Nicotiana sp.
MSSSNVATPNSPSSSFGSCLLDENIEETTILESQSEPEEGGKAAREENTKQYWRRYIGVRRRPWGKFAAEIRDPERRGARLWLGTYQTPEDAALAYDQAAFKIRGSRARLNFPHLIGSNNMPEPTRVTGIRHNSRSLEPSSTSSTTSSENGTKEKKYRGHKFYSQSQIGWSYPRPRDINITIRKEEFSVLFPNAATLLHK

SEQ ID NO: 39 - protein, 191 aa, Nicotiana sp.
MSSNNASPSSPISSFGSSPSAENNLNTSLWDENFEDTIQNLEEKSESEEERKGLVVAREKNAPQDWRRYIGVRRRPWGKFAAEIRDPERRGARLWLGTYETPEDAALAYDQAAFKIRGSRAQLNFPHLIGSNMPKPARVTARRGLTRSPKPSSSSSTSSSENVTRKRKIDVINSIAKAKSVCHVWNLQLLL

SEQ ID NO: 40 - protein, 217 aa, Nicotiana sp.
MNPADNATFSFSDLDFLDSIDHHLLINSDFSNSFSPMSSSNVATPNSRSSSFGSCLLDENIEETTTLESQSETEEQTQGGKAARERNTKQDWRRYIGVRWRPWGKFAAEIRDPDRRGARLWLGTYETPEDAALAYDQAAFKIRGSRARLNFPHLIGSNMPEPARVKGSCHNSCSLEPSSSSSTPLSENGTRKRNIDVINSIAKAKSVGHIRNLHMLL

SEQ ID NO: 41 - protein, 229 aa, Nicotiana sp.
MNPNNATFSFSELDFLQSIENHLLNYDSDFSEILSPMSSSNALPNSPSSSFGSFPSAENSLDTSLWDENFEETIPNLQLEEKSESEEETKGHVVAREKTTTQDWRRYIGVKRRPWGTFSAEIRDPERRGARLWLGTYETPEDAALAYDQAAFKIRSSRARLNFPHLIGSNMPKPARVTARRSRTRSPEPSSSSCTSSSEKGTRKRKIDLINSIAKAKFIRHSWNLQMLL

SEQ ID NO: 42 - protein, 124 aa, Nicotiana sp.
MSSSNALPNSPSSSFGISPSAENSFETSFWDENFEETIPNLEEKCESEEETKGNVEAREKNAPQDWRRYIVVKRRPWGTFSAEMRDPDRRGARLWLGTYETPEDAALAPLSKSAARELGSIFLT

SEQ ID NO: 43 - protein, 191 aa, Nicotiana sp.
MSSSNALPNSPSSSFGSFPSAENSLDTSLWDENFEETIQNLEEKSESEEETKGHVVAREKNATQDWRRYIGVKRRPWGTFSAEIRDPERRGARLWLGTYETPEDAALAYDQAAFKIRGSRARLNFPHLIGSNIPKPARVTARRSRTRSPQPSSSSCTSSSENGTRKRKIDLINSIAKAKFIRHSWNLQMLL

SEQ ID NO: 44 - DNA, 4077 bp, synthetic construct
  misc_feature 1..4077: note = Description of Artificial Sequence: Synthetic polynucleotide
  source 1..4077: mol_type = other DNA
aagcttccagaaggtaattatccaagatgtagcatcaagaatccaatgtttacgggaaaaactatggaagtattatgtgagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtatgggaagaaaaccatgttgtgtaaaagagggattgagaaaaggtccatggtcttctaaagaagatttattacttactaattatatcaaggaaaatggtgaaggacaatggagatctttgcctaagaatgctgggttgcttaggtgtggaaaaagttgtagactaagatggatgaactatttaagaccagggattaaaagaggaaatttcagtcaagatgaagaagatcttatagtgagactacattctcttttgggtaatcgttggtcactaattgctggaagattaccaggtcgtacagacaatgaaatcaagaattattggaacacacatttaatcaagaagctcaaaaatgctggaattgaaccaaaaccccacaaaaatttctccaaatgttccaaaaaggaatcaagaaaaggaccccaacaagggaaatcaagaaaaatacaaggcaaaaagagcaacaacaaaaacaataagggtcaaattgtacaagttgagaagaccaaagtatttttcccaaaacccatcaggatttcttgtggaatttcaaggaacaatagttttgaaaatgttacattgagtactacttgttcctcaaatagtaattctggagaagctaatcttgaaaacaaggaaaatgaggtgaaattagaagaagtttcattctttccaagggacttagattttggtaaattacttgaaggggatgcaatttatgatgaatttctaatggaagaaagttgccacatttcaaacaaatgttcattgccaatgaatgagagcatgttggagaaagtatatgaagaatatcttttacttctttctgaaaattgttaccttcaagatgatcatcaaaatgagcaaaatttccctgtaaatgtttctgatcagtgactcgacgaactgacgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggaagcttccagaaggtaattatccaagatgtagcatcaagaatccaatgtttacgggaaaaactatggaagtattatgtgagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtggatccatgctttctcccatagaagccattgtaggactagtaaccttcacatttctcttcttcttcctatggacaaaaaaatctcaaaaaccttcaaaacccttaccaccgaaaatccccggaggatggccggtaatcggccatcttttccacttcaatgacgacggcgacgaccgtccattagctcgaaaactcggagacttagctgacaaatacggccccgttttcacttttcggctaggccttccccttgtcttagttgtaagcagttacgaagctgtaaaagactgtttctctacaaatgacgccattttttccaatcgtccagcttttctttacggcgattaccttggctacaataatgccatgctatttttggccaattacggaccttactggcgaaaaaatcgaaaattagttattcaggaagttctctccgctagtcgtctcgaaaaattcaaacacgtgagatttgcaagaattcaagcgagcattaagaatttatatactcgaattgatggaaattcgagtacgataaatttaactgattggttagaagaattgaattttggtctgatcgtgaagatgatcgctggaaaaaattatgaatccggtaaaggagatgaacaagtggagagatttaagaaagcgtttaaggattttatgattttatcaatggagtttgtgttatgggatgcatttccaattccattatttaaatgggtggattttcaagggcatgttaaggctatgaaaaggacttttaaagatatagattctgtttttcagaattggttagaggaacatattaataaaagagaaaaaatggaggttaatgcagaagggaatgaacaagatttcattgatgtggtgctttcaaaaatgagtaatgaatatcttggtgaaggttactctcgtgatactgtcattaaagcaacggtgtttagtttggtcttggatgcagcagacacagttgctcttcacataaattggggaatggcattattgataaacaatcaaaaggccttgacgaaagcacaagaagagatagacacaaaagttggtaaggacagatgggtagaagagagtgatattaaggatttggtatacctccaagctattgttaaagaagtgttacgattatatccaccaggacctttgttagtaccacacgaaaatgtagaagattgtgttgttagtggatatcacattcctaaagggacaagattattcgcaaacgtcatgaaactgcaacgtgatcctaaactctggtctgatcctgatactttcgatccagagagattcattgctactgatattgactttcgtggtcagtactataagtatatcccgtttggttctggaagacgatcttgtccagggatgacttatgcattgcaagtggaacacttaacaatggcacatttgatccaaggtttcaattacagaactccaaatgacgagcccttggatatgaaggaaggtgcaggcataactatacgtaaggtaaatcctgtggaactgataatagcgcctcgcctggcacctgagctttattaatctagactcgacgaactgacgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgg

SEQ ID NO: 45 - protein, 6 aa, synthetic construct
  REGION 1..6: note = Description of Artificial Sequence: Synthetic 6xHis tag
HHHHHH

What is claimed is:

1. A tobacco plant, or part thereof, comprising a first genetic modification comprising a non-natural mutation that introduces a stop codon into SEQ ID NO: 13, wherein said first genetic modification suppresses expression of SEQ ID NO: 13 or activity of a polypeptide encoded therefrom in said tobacco plant, or part thereof, wherein said tobacco plant, or part thereof, further comprises a second genetic modification comprising a transgene comprising SEQ ID NO: 44, and wherein said tobacco plant, or part thereof, further comprises a third genetic modification comprising a transgene comprising SEQ ID NO: 3; and wherein said second genetic modification increases nicotine to nornicotine conversion as compared to a control tobacco plant lacking said second genetic modification; and wherein said third genetic modification increases the level of one or more antioxidants in said tobacco plant, or part thereof, compared to a control plant lacking said third genetic modification.

2. The tobacco plant, or part thereof, of claim 1, wherein said tobacco plant is a *Nicotiana tabacum* plant.

3. The tobacco plant, or part thereof, of claim 1, wherein said tobacco plant is of a tobacco variety selected from the group consisting of a flue-cured variety, a bright variety, a Burley variety, a Virginia variety, a Maryland variety, a dark variety, a Galpão variety, an Oriental variety, and a Turkish variety.

4. The tobacco plant, or part thereof, of claim 1, wherein said tobacco plant is male sterile or cytoplasmically male sterile.

5. Cured tobacco material from the tobacco plant, or part thereof, of claim 1.

6. A tobacco product comprising the cured tobacco material of claim 5.

7. The cured tobacco material of claim 5, wherein the cured tobacco material is selected from the group consisting of air-cured tobacco material, fire-cured tobacco material, sun-cured tobacco material, and flue-cured tobacco material.

8. The tobacco product of claim 6, wherein the tobacco product is selected from the group consisting of a cigarillo, non-ventilated recess filter cigarette, vented recess filter cigarette, cigar, snuff, pipe tobacco, cigar tobacco, cigarette tobacco, chewing tobacco, leaf tobacco, hookah tobacco, shredded tobacco, and cut tobacco.

9. The tobacco product of claim 6, wherein the tobacco product is a smokeless tobacco product.

10. The tobacco product of claim 9, wherein the smokeless tobacco product is selected from the group consisting of loose leaf chewing tobacco, plug chewing tobacco, moist snuff, moist smokeless tobacco, snus, and nasal snuff.

11. A tobacco plant, or part thereof, comprising a first genetic modification comprising a transgene encoding SEQ ID NO: 5, wherein said first genetic modification increases the nicotine to nornicotine conversion as compared to a tobacco plant lacking said first genetic modification, wherein said tobacco plant, or part thereof, further comprises a second genetic modification comprising a transgene encoding SEQ ID NO: 6, wherein said second genetic modification increases the level of one or more antioxidants in said tobacco plant, or part thereof, as compared to a tobacco plant lacking said second genetic modification; and wherein said tobacco plant, or part thereof, further comprises a third genetic modification comprising a non-natural mutation that introduces a stop codon into SEQ ID NO: 13, wherein said third genetic modification suppresses expression of SEQ ID NO: 13 or activity of a polypeptide encoded therefrom in said tobacco plant, or part thereof, compared to a control plant lacking said third genetic modification.

12. The tobacco plant, or part thereof, of claim 11, wherein said tobacco plant is a *Nicotiana tabacum* plant.

13. The tobacco plant, or part thereof, of claim 11, wherein said tobacco plant is of a tobacco variety selected from the group consisting of a flue-cured variety, a bright variety, a Burley variety, a Virginia variety, a Maryland variety, a dark variety, a Galpão variety, an Oriental variety, and a Turkish variety.

14. The tobacco plant, or part thereof, of claim 11, wherein said tobacco plant is male sterile or cytoplasmically male sterile.

15. The tobacco plant, or part thereof, of claim 11, wherein said non-natural mutation results in a reduced level of activity of a protein or polypeptide encoded by SEQ ID NO: 13 comprising the non-natural mutation as compared to a protein or polypeptide lacking the non-natural mutation.

16. Cured tobacco material from the tobacco plant of claim 11.

17. A tobacco product comprising the cured tobacco material of claim 16.

18. The cured tobacco material of claim 16, wherein the cured tobacco material is selected from the group consisting of air-cured tobacco material, fire-cured tobacco material, sun-cured tobacco material, and flue-cured tobacco material.

19. The tobacco product of claim 17, wherein the tobacco product is selected from the group consisting of a cigarette, cigarillo, non-ventilated recess filter cigarette, vented recess filter cigarette, cigar, snuff, pipe tobacco, cigar tobacco, cigarette tobacco, chewing tobacco, leaf tobacco, hookah tobacco, shredded tobacco, and cut tobacco.

20. The tobacco product of claim 17, wherein the tobacco product is a smokeless tobacco product.

21. The tobacco product of claim 20, wherein the smokeless tobacco product is selected from the group consisting of loose leaf chewing tobacco, plug chewing tobacco, moist snuff, moist smokeless tobacco, snus, and nasal snuff.

* * * * *